United States Patent 10,590,436 (CRISPR-CAS SYSTEM FOR A LIPOLYTIC YEAST HOST CELL) - sequence listing, part 7

SEQ ID NO: 4 - DNA, 20550897 bp, Yarrowia lipolytica CLIB122 (residues 12,330,541-14,385,630 of 20,550,897)
  misc_feature (805062)..(805161): n is a, c, g, or t
  misc_feature (1509648)..(1509747): n is a, c, g, or t
  misc_feature (1510607)..(1510607): n is a, c, g, or t
  misc_feature (1510615)..(1510615): n is a, c, g, or t
  misc_feature (1510620)..(1510620): n is a, c, g, or t
  misc_feature (1510625)..(1510626): n is a, c, g, or t
  misc_feature (1510628)..(1510633): n is a, c, g, or t
  misc_feature (1510638)..(1510640): n is a, c, g, or t
  misc_feature (1969952)..(1970051): n is a, c, g, or t
  misc_feature (1993008)..(1993107): n is a, c, g, or t
  misc_feature (1993730)..(1993730): n is a, c, g, or t
  misc_feature (1993732)..(1993733): n is a, c, g, or t
  misc_feature (1993755)..(1993756): n is a, c, g, or t
  misc_feature (1993795)..(1993796): n is a, c, g, or t
  misc_feature (7074860)..(7074860): n is a, c, g, or t
  misc_feature (10088936)..(10088936): n is a, c, g, or t
  misc_feature (10711579)..(10711678): n is a, c, g, or t
  misc_feature (10711830)..(10711873): n is a, c, g, or t
  misc_feature (10755124)..(10755124): n is a, c, g, or t
  misc_feature (10755133)..(10755133): n is a, c, g, or t
  misc_feature (11338680)..(11338779): n is a, c, g, or t
  misc_feature (12388623)..(12388722): n is a, c, g, or t
  misc_feature (12655330)..(12655429): n is a, c, g, or t
  misc_feature (14664490)..(14664589): n is a, c, g, or t
  misc_feature (15198478)..(15198577): n is a, c, g, or t
  misc_feature (18230124)..(18230223): n is a, c, g, or t
  misc_feature (18756577)..(18756577): n is a, c, g, or t
  misc_feature (18756579)..(18756579): n is a, c, g, or t
attgtacgattacgcattcgttctgtctgctatgtgtgtgtgcttattatcatgtctgttcgtgctatatagaggagacgactacttgcagtaggtctgcttcaggtatctgggttagaatatgtttagaaaacgccttaggcattatagtaacatcagcgatcttggtgataaaagattgtcttcaggtgtacagaaaagtagcagatagttatcatcagaggagaggattgctgaaggagttactcaccataaagtctctatgtagagtgtgtgtgtgcgtctgtatagttaatcatcgtgtttgtgtcggaggtgtcgttagtggcttgtcaggtttgtgtcgcaggggtatcactgcctagagagagattgacattgagtcgtcgcatttcaacctttgttagaatggctcgtcaaaaattcactgacaatgaacgaggagtcagacgagaaagagcatatcagttcggccatctgcttgtagaaactaggcatgtctcaacagaatggcttctcaatcgcaaattatatcatcatgaaatcttcttccaaaaggaactcactcttaggctgttgtttgctggtgtgttgaaagctgttgtatgtttatgattgtgctctatggctgaagcttctatagtgtcctggcacaataattttaaggtttatatactgactcctttgggatatatttaagttgtgactgtgccctaattgatatcacatgaccactcagtttccctttcgtcccaaatctaattgtgccactcacatctggattttgaatttttatcaagtcttacacatcgacacatacagacatcaacaatgaccgaagtgaagagcgttaactggagactggtcgaggctggccgaattgtcctcatcaaccgatctgacaacaagtccactcagggcaagcttgccatcatcgccgagattgtcgaccacggacgagtgagtattagaggaggagcatgaaatgcgacacagcaagtgtccagccacgggagtgtcggggcaagttcagtggaatgctcacagcatgctgaatgccttgtttgcaacatcaccgatgcaacacccttatcatgttgtttgaaacaagtactaaccccaggtcctcatcgacggccccaccaccggcgttgcccgacaggttgccaacctcaagcatgtcacccttaccccccacgttgtcgagggtgtcaagcgaggcatgaagtccaagaccatcaaggctaaggtcgaggcttctcctgctttcaaggagtggtccgagtccagctgggccaagaagatcgctcagcgagagcgacgacgacatctcaccgacttcgagcgattccaggtcatggtccaccgacgagagcgaaaggctgctcttgccaaggctgtcgccaaggcctaaatcaaaatttgatgatgtacaaaaggagacgcattactagcgcgagtaatagcatttatttaagcctaggtgatgtaaaggatattaaaaaaagtatttgatgcagagatgtgtagaaattggtcttgtaattgtggtatgaggggcatttatagtacccctagtcgtagtgtctttgcgagtgctgagatacatcgtataaacaactgcatgtttgttcacacagcacgaacagctgttcgcaaaaggtgtggagaagtgtgtgtacggtatgcaccggtatcgtagctactgttgccgcggagagaaacagcttattaagatagatcacttgacctcttttagggcatgggggaagaacatagtttccagttgactaatactgtagatcttgccatataacgtagcatgacatgggtatggacttggactagaagattttattatatacatgatgggacgctgtagataacatcgcatcgaaatggaaagatggacagtggcccgcggagaggcgtaccaggcagtaatcgaacgagagaaatcagatagagtagatggtctagagtgactggcaaaagtctggcatcacttctattgcatcatcaagtgagcagtcttaaacggtccacttctgccttcgggtgtctatcgttatctctacttcttctcgagagcctcccactcctttggagtcttggtagtcaaagagagagcatggagaccattgggctgggccatctcttcctcgaacagcttgtataccattctgtgtcggatgggagcgctcttgccctcaaacttgtcgctgacaatggtcagtcgaaagtgcgactcgatagtgttgtccgatccccgcatggcagcatggtgagcgtgcttgtgagagtcgttgttgaccttgaaaaagacaggggtgaactcctgcttgacccgggagttgatggcatcggtgatgggcgtgttggaagaggacatgtggcggagtagcgtcgtttgtcgcagcacgggtcgaatacgaagcattatgtaagttcggatgatggtgtgggattttcccagaagttaaacagagtggagagcgcaggaggagtttcactgtgcatgcattacgaagcaggaaaagtgagtgtcgagaggactggttcgatggagggggatacgggtttgagagtaaattactgtagtaaaatgctatggccataaattagaacagtgaaatctcgttctgttgtactgtcttgatatagaaggctgtaaattccgtgtttgagtttagtttcgctatcacgtttttagttgactgtttacttgcatctcgatttcatacttgggagtcgatgctctggttgtaagggtagctgtgttatgcactgtgggtacgtatctataccgtgcgctgtggacatatggaacttgaacactccatagagctcttatcagagcccctgctttgcactaaaagtccgtagtactttctatcttcacatccattttttccatccaatcatacttgtcattcgtctggcatctctatggcttggcaaaagtatccaagcaccatattggctaccggcggctacccttaaaaaaggcgccgaaagctcaagatccgcctccactctcatagacacagtcttgggcagcggcatgaggctgggtttcaatgaatacgttgccactgtcctcaaactatcaaactatcggcacaataggctgagtgactgcatgtgttatggtgttgtgctgataaccagaagcggatgtggacaaattatttaaacaagagtccgtggcagtacaagtacgaacgagtatcgtagtactgggcccgttctattgggattttgtagggtggagtgtaccgcttactacaattgtagctattgcaagcttaaccagcacccgcaaatgttcatcgccccgattggcatcgtttgtacagtaaatagctggcggtgtactctgccacacatggtacagcccatacatgaggtatgtacagccatgtacgagtgcagaaaatgtgccgaagttgttggaaattacacactgtggcggttccacttaaatctacgctacttgtaggtatatagctaatgatatacctcattcctatcctcattcctctacagtaaaacattatctcccccttcattctcccaagtagtgcgaatcacctcaactcctctggttgtaactccgtgttatgattttgggacttgcacagagaagacgtacgtgttgaaataatgacgtagaagggaaagtgtggtagagaaaggagatacagccagggacgagagaacggaaacctgcaaaaaaaaaacacccggacccgtagctccactgttgccacttacacagccctgacatatccttgtaacacacttttcaacccgtcacgtgcaaattcaaatgccgctagctaaaaataaccttgttgtgtgaaacctcacaaaaatacccagtcctgcagttggctacattattctcaactcctcacagtcgtcacacatccccgacttccgacatgtcctcttctgtcccatacgacccctacattcccggtggcgagtccaacgcccccggcggtaaccacaagaccgccgccatccaggcagtgagtatgaattcgtggcactttcacgagaattaaggagacataacgtcagacacaaaaacgagataccagcagctcagaggatggtaaaggcacggtggccagttggaggcatcagaagagtcggttgtttgttgcgtgaccagtttgtgcaatcaggtgatcgtttgtctatatggctcaccgtctgattatgacggatgcctgcccaactgtatcacacactgtcacgacttccacaacaagcacgactacacactcaacagagctgaaggtttcacttgtgagacgccagctgttgagcggcgttcttggaccgtttcaccgttaagatctctttatcatcgtgtcatgtgactggtatcaccatgagttatcgaccgcatttccctggccgtgtttcttaatatccccgaaacaccacatctgacaaattctaacccagcaaatcgatgataccgtgggtatcatgcgagagaacatcaacaaagtcgccgagcgaggtgagcgactagactctctgcaggacaagaccgataacctggcagtctctgcacagggtttccgacgaggcgccaaccgagtgcggaagcaaatgtggtggaaggacttcaagatgaagatctgtctcatcattggtgttatcattctgattgtcgtcattgttgtccctatcgccatccatttctcataatttattagaccccccttatggtcttggtcttaatgcctatgtaatgaatctgtacttttctttggccagatgtttgtgaaatacttgcacaagcatccatcttactgactggtcctgtagctttgaaaacatcttcgttggtataaacggaggtgttgtctacgaaccatcaggtaagagcttcattggctacagcatatactgtggttgtagatatccgcattacacacagtatatactgtacttgtacctgtgttcctggtgtgaagtacgagctactacaagtagtaactacagtaacaatgtatccgacatggcaatactttgtacatactcatgcggaccatattgtgttttagtatcaacacatctctccatgcaagatacagtcacgtctgtggtcaggaatgtgtctagagtgacgataattatgtatgagaggcgtgcgagaaactcctaatggtagttctaataataaatgcaatcgtattatcgattaccagaaacttggtatctacaaaattattccacggatctggggaactggagagagttagtatggaccgagagagtggtgatattcaggaatacccgacccaagactgaggaaggataagactttacgacaatttaagataaggatggcatggaaagtagctaccggaaggacatgactactgtatggtaattagcacacagtgccccacggaggtttgatatctgtgctgattagtgagacagctttagcagaggtgagtaaggtacagcaggcaacgacctagctgagccgttaatgtaaatcattatcggttctcaggcgaatcctacaagggaattgtatgggattccgcaagacattgtccgtctatggtgtctgtatgtattataagatggctagatatgtctcagaagtacaactagtggtgagctgcaactttgtcgtgtcgacaatctgtaataatgtacaagtgcgatacaaggggcagcatgtaagtcgagcactgttaatgaaacatgatagtccagagattttcaagccagagacttcatatactggctagttattccctatatacccccaagcagactcataatgtcctcctggaacagtgattctggaaaccacatcaacctcagaaaccaccctccagccagtgccaacttccgattcaagacagccccttaactgttccacattgcgtaaacacttcaacttcttccaggtctgtttttttacactcattgctttcacttcagcctgcgtctagtccgtaatgtggggtccttggcaacaagagtatggctggactgtagaccagctgaacaactcgtatgccctttctgtggccggtctgggacttggatctcctattttcattttcctacaaattcggcaaaagacccgttttatctgacagtttcagctttagttgtcgtctgtgaagcctcgcaggcgtggatgaagtccatcgttcaagtctatgggtccatgtttgtctagggtcttgctgtgagtgtggatgagaccattattcaaatgactgttgcagacctctacatcgttcaccaacgaggcacgtactacaatggtatctacatgtttgtggtagaggtgggcaactttctcgttctggtgccttcaggatatatcaccctcaatctcagctggagaatggtgtacatcattgttgttattattgctggagttcagttcgttatgacacttctgttctttgaaaagaccaattatcgggtatctggttacagtagttgccgaactgtccgagctgggagaggttcaattgtcagaagaatacaacaaaccgagtcgatctcatggaatcgaagatgctgtcctttctaatagtctggacactgttaaattagagacctcaggcacggacttggagatacagacaaacaaatcactcctcacaggttcgttcggactactggctcttatcacttacacttctggaagctgggtcgaattttcccggaaattgattacgccctttaaaactctcgtcacataccctatcgtgactttttgtgctcctcaatacggattcttgctctccaggctatctatggcagccaccatctcgggcaactcctttgttcaacctccatataacttttcagctgaagctattgacaatgtcaatattgctccttgtgtaggaatgattttggggtgtctctttgaaggttggtttcatgatatggccatcatctggctcagcaaaaaccaaggagtccacgaacccgaattcaaactctacagcctcatgaagtccaacttctccatggctatcggcattctcctattcggaatatcgactgctctcggtgtccatggatggtacccactgtcggatttgcaatcatagcttttggattcgggtcgtcatgggctattgtggtcacccatctgctcgactgctatgagaaaaaggtgccgacgccttcattggggtcattatggtccgtaacgctttggttactgcaatcattcttgtccagagataaaataggcatacagaacgtttatatctctgcgaaatgcttcacgctcatccccttgtttctcaccgttccagtgatcgtttggggaagcatttgagacgaatgagtgagagtcgttacttgatggagtctgtgagagactgaatgggtctggttgagcatccatatcttactgtttttttaagcaaagtattgtgattctaaaaatataaaaaatgtgtgttactgtataattaataagatcgatgtgagcatagcctgttgttatgaataacttttgatagagtatgaattggactttactttagtcagtgtacgaaaattacaccgacgaagactacgtaacatgattatgggaatatcccagaaagtacacaaaactggctttcaataataccgtatatcgtgagctatatcgtgagcgtgagagctcacgatatacggtgcacgccatatatccggtgcatgccatatatccggagcaagcatcattcatgcgtgataatacacccttagcaaatctccataccgccgcggtgctaatgtaacgcacatgtgtgtactgcacacggaactactaaatttatatacagtactgtacaagtatgtacaagagctactgttcacagtgcaatttctctcaaaacagccactaccgaagcgcgttaacttaccgtggctcactgtctcacttgtgccacaatgccacatccgagtctcacaaagttggggagaaacatgtgagttggtgcataagacacagagaagaccggatcatttgtgccgggtctttcgggtctttttcggggtggatactattgccacgaatcaaattctagttcatgcaggtactgtatctacaatcttacaagcatctcgtgcttgtgcttgctcaaaacatcgtaaatcatatcaactatacttcgcttatttggcgaccttaataatctcctcgagagagagagacttgggtcgctcaatgggaagacccagaattcggtcccagaccagctgaggcagaggaccaagagctcgggacacaccgaaggtgacggtgtagtacagagtctcgtggataccgtagtggtggaagaggacaccggaagaggagtcgacgttggggtgggggttcttggtcttgccgtgctcggtgaggacgccagtggcaacctcggaggttcgggaaacgagctggaagacggggtcgtctcggatctcctgtcgagagttggcaaagttcatcagagcctcgaatcgagggtcaggctttcgcagaacggcgtggccgtaaccggggatgactcggccagacttgaggacagaccacaggtacttgacgaggtcctcgttggagtagcccttggggacgttcttctccatgtcgaggatgaatcgcaggacctcctgggcggcgaggccgtggagaggaccagcaagaccctggagaccagcagagtaggacaggtaaggatcggacagagcggatccaaccaggtgggtggcgtgagcagagacgtttcctccctcgtggtcaccgtggagagcaaagtagagtcgcaggagatcaacgaagccggtctcatcgcccttgcccatcatagcggcgtagttgtaagaccagtctcggttgagatcaatcttgccggggagaggtcctccaccaaggtaagagttctggtagatcttggcggcaatctggggcagcttggcaatgaggtcgatggagtcatcgaaggtgtactcccagtactcggacttggggatacctcgctcgtaggccttggcgaacttggagtcgtggttaagggcagacacggccatggagaactgggtcatggggtgcagggtagggggcaggttgtcgagcatcttgttgacaaactcggggacctcgcccttctcagcgagctctcgagacaggcctcggacctgctcctcagtgggaaccttgccggtgaagaggaaccacagcatggactcggggagcatctcgccgccctcaacggccttggggagcacctcctggcactccttgatggtcttgccgtggaatcggataccctcatcagcgtcaagaacggagccctcccagagcatgcacttgaggcctcgcatgcctccgagcaggttctcgaccttgcaatcaccgagagacttctgggagtactcggacttgaccttcttgaagagctccagcttggcggggatggcctccttgagggcgcccttgaggtcagaagcaaatcgcttctggaccatggaggacacggaggttcgggcaacacgggcggttcgaagagggatcattgtgttgatgtgtgtggggttagttacgaagactctagaccttgttcagagcgggcaggctcacttccttatataaagctggctcgtggcaatcagacccaatagccaaaagcacaaaacgggcctccggttaaccttgtctttgtatgcgtgaatgtgaatgccgggggtgagccgagacgacggatgagtataggatggtgtgtgggacagatggaaagataagtaaagctggaaacagagcaattgatggggaattttgcttatgtgtcttttttagggctctcagatcagccaattacagtataaccagtgggctccaactcctccaatatccgtttctccataaactctgacgtttgagtttggacacgtccgacccggctttctcggagggctttgcaacaaagggccccgcgcctgacattattattcattgcctgcaaattcctggcaatggatcttttatttgaccggtgacagaaattcggcgcgtttccccatgattgtctcctgtactcacggagcccatcacatggagtacactaagattgtttgagagtgttagacctcgaggaggaaaacgtgaaatacaattgaggtgtacgcgggggtagggttttaggatcgacgactgtttgtagaatgtgtgtgagaagcaatgggattaaaccagatacgtttctgcggctgtgcagcctcgaggaaacgattctctccttttccctacccaattgatatataattcacactatagtctagatcggtcatctcggcccatttccccacgtttttgtggggtgcaggtttgatgcctcgaccaccttgttgggccggtagggtaaccagggcagagctggaacagaccatacacaacaccgagtggaatcagaagagatgtgcggctccggatataccggacacccctatatttccggcttggagatatttattgcgacccagtatggcagcaattggtgatgcaaaacacaataataccacaaacgcactaaaagcaggaacttgctaataggtcgtgggggatgagcggggatacggcgcaactaatttcaaggcactattttctgaccacgcaatgatctctctccttttggtaaacgtgtcatgaactatacccataaggatttgcgcctgtcttacaaccgttgagtttggagtgaactctttctcgaaaaaacagcgaaattcagtacgcgcatgattcctcctgtgtacgatagttgacctcggtgggtttcgaacccacgacctcacgcatgcagacgcgataaatggatcgtatcgtaacctaaagtaaaaaaaattggacatgcagtaatcagttctgagaccttgtagacacacacaaacatgtcggacgacgaaagggaaattgatatcaccgatctctcggtcagggataacgagctcgacttctgcgacgatgcctctgacgatgagtacgctggagacgtgacctgtcttttcagcgaggccaccttcgctaccaccaaagagctgttcgagcacatgaaggagaaatacaactttgactgggccgaacacaagcccaaggagagcattgaccagatcaagctggttaactacatccgaaagcataaggaggcacccaaggccggagagacgctgtcggacgagtacatgacccctgttctggagaacgatatgctgatcatgcgactactcgaggaggacgacgatgaggaggagaaagaggttgatcctgtcgagaggctccagcaggagaacgaatttctcaagcagaaactcattgaggccaaccgtctacttgcctcggctactgacgattcttctgccaatgctaacaagtccactctttcttcgtacgacactaattacttcgattcgtacgctcacaacgaaatccacatgcagatgctcaaggaccgagttcgaaccgagtcatacagagatttcttctaccacaacaaggacaagatcaagggcaaggttgttctggatgttggatgtggttccggtattctgtccatgtttgctgccaaggctggggctcgacgagtttacggtgtggacaactctgatattttcgagaagactattcttaatgtgaaggagaacggctatgatgacgtcattaccctgattcgaggaaagattgaggatatcagtaagaaccctgctgcctttggtatcaccgagaaggttgatatcatcgtttctgagtggatgggatacggtcttcttttcgagagcatgcttgactccgttctggttgcccgtgacgctctcaagcccgaactcatggctccatctcagactactctcgtcgtttgtgcttctgatgacaccgagtacctcgataacgtcgcttactgggatgacgtttacgagttcaagatgactgccatgaagcccaagaacgtcgagtctgccaaattcgtggagtgccccattgaggtctaccccaaggagactgtggtctccacttttggcgtcattcgagagctcgagctgcataccttgacgctgggcgaccttgccgacttcacttcggacttcaagattgtcatggagaaggatgccgacgtgactctgctcattgtgcactttgataccttctttactgtcgatcgagagacacataccattgagaaggactcccagactggctcgtggccctctcaaggaaccggcatttctttctctaccggtccccatgtcacccccacgcattggaaagctgccggtctccctcttcagaagaagtaccctctcaagaagggtgacgtgattgagggaactatgcgattcaagaagggtcatgaaaactcccgagatcttcacattgtcctcgacacaaaggtcggaggagatgatatctccaaggtctacaacatcagcgcttaatgtatgtaaaagtatatagaacagtttagaataggtctaatattaaccaaatgtggcatcatatatatacgtactattgttgaagtttctagttgtagtgttcatgtgtgtcactcctcgaaaagggtcacgaaccccattcttcgcttgtattccgcttgtcccttctttgagttgtcgcacccaatcttggcgaccacgttcagatcaaggtcgttgaatgtgaggtctgaggtctgaatgggctggtcaaccgaaatgttgaaacagcgccatccgagtgtacatacctcgattatctcggatgcgagagcgaggggccacaggtgcttgcccttgaaccagatcagcgtgaggatagccgcccctgcgaggtggttttcgtatgtgtttgcgggaacaatcttcttccacacctgtcgatgctggatcatctcgggcgtcatccatgtgcagagtgcgaatgctggcagtagttgtaatctgcttcctacgtatccaatgtacaatctcgtcagagtaagcaccccgaatcgcatgtatgggtcgatgtagtccatacgcacaatcgcagaagtggtgagaataaccgaaatgatacttaggaggtaccgaaccagcagggcgttcaagtgtcggggcgtctggagaggtttgggagggatcatgtatggcagtctgatgatgatctgccccatgacatagagccccagaaacattccaatgttgtggttgtcgagaccgatccacagagatagaagcgcgtatgtgccgacatgtggcccggtcatgaacaggaacacctggttcagtgtagtcacaggtgctagtttgtgacagactgtaaccaacgtttcttcgtctgaggcgtagtctaattgcattatctctgttctgaaaagacgcgagatgtcttctgtggagttgtggtttgtttcagcggttcgcctgtcgtctggtggccattaagcccgtcgtatttgttgttgcgtgagatttggagatctgagaaaaatcgagtgcgttgccgagcatgcaggtctcatgcggcctttacgatgtagacggcatttagccgtttttggtgggttcgggcaagttaaacttataccggctcttcggttgttgcggcaaacccagtgcttctttcgagggtactgtaggtatgaggacgtcgcgagtgattgtccttggagcgtgttctttttttggggggcgggcataatagttcctcttcgagggttcacaagatgtttcgaggcgctatattcaagttcacgtgatcagtggccatgcactgcagtatatacgcatccatcttgtaatagttatataggtgccatatgttcaataatgtccaccccgacatagaagtgcctcatcttcaagtaaactttgccagacaaggtttgtgatacagcaaatgactgtgattactaattctctcacgcaggattatgtacttgtaatagggtgcgagagctttctatatgcgcagaagctgatgataacccgcgatgctatcgcactcgcatgccttagcgaggacggcctgctggcaaggcatcacacgggggcaaccagacattggcagaacacaagtagccacccagccatgtcactctgaaaagtgccaaccacaacagcaaacgcgctgacatgtgaaatcagttgattaataatacgatgcgccaatggtggcgaatgtggatagaggagaagagcaatgccgatagaaggactaacgaatggcccgacgagcatgtgtcattattgcaaatgagaattccagggacccaagcacgactacacaatgcccgaaaaacagtaagggagtctgcggtactacaagtagctagagcagcgatgtcgcccatcaacatatcacaccgaccccatatgtatgtggggacctcatgtgtcgagaccaaggccgtacaagtacgagtactcgtacatactacaagtagcacctctgaatccaaacaggtgcccctcgacaactcgccaatcaaaacaactttgtaaagcagtccatggactccgtggagagacggtaggctcatatgatgccgaggagccagcggaagtagcagctcatcccgaagaacaagggtggagagtacagaaagaaacaccatccaagacaaggacaatcacgcgagcaacccatttccatccgcccaccgaacaagagacaaaattgacctggttgcacataattctagtgcaattgcagttgccaaatcgaatatttccgatagcagcctcgggtataagatttgcatacttcaagtggatattagtacagtgaaacccaagcgctattatctataaaagtactaccatcgattacctatctctctttacttagttacaatcccagccgtctctggagagcaagcttgccctgctctgtggtgacgtcgataccgtactccatgaaccgtaagctctcgacgggatggaagtaggcaaagtaaggaatggccatcttgtggtgcactccgtagacctgggccataacgtagagtcccagggctttcaatggccaacccaaaagctcaaagccgtcgtctttaggttgaacgatggcgtatagagcgacgtaggaaagggggaaggcccaggcgactcccagacccacatccacgtatttcgtgaaaatcatgctgccaaaccggtcaagggtcttcttggagaagacctgtggaagaccaaaaccaggcaaatatcggagtcgcttcgtaatgagagtagcccaaaactgggaggcaatcagaatagctatcttcagacccagtacagtgtagtccacagccccgtcagaagagagaccaaacttgccattgatgtaaagccgagtagagagaaccacaaacaaaaaccggtagtagttgatggtaacatgcgagttgggttccgaaaagacgattggcttgggaacaacagccttgctgatgaaaaatgcaactcccacaagagccacgaagcctgcgacaggaacaatggtccgcatgttacccgtcagacttgtgtcatggaggtacagccagtgcattagccatcctgcacccagggaaaaccgtccgaggggactggccatgttcttggtggctctattgacgcccaggccggccttcatttgctcacatctctcaattaccaacttttcgtcggtggtatcgtatcgctgttcaaaatgatgtgacatggtgtatcgtagtaagagtgttgataactatatggtcccgcgctctctttatagagggggaaatcacatgcgccagctttaatctggaaaagaaaaccctttgtacgtacacccgcaagtctgctactaccacttcaaggcacacccaaagcttcaaccccacgttcagactatcgttttgaacctaagataaaactcaatggaccggtgacttttgaggtttcatgtctttctaaaccaggctagagcgtatgacatgataaagtgtctctttattagcattgttttacacgtgaaaacttcacggaatcgcttttctttgtacccacactgccccccaccacgcgacctccctcgcgctcccctatcactcttttttgctgcagcgaagtgtttcagttccccactaaatcctgatcggaagaactctaacctccgtagctccgtccatgtcaccctacagtacgtactgtactggtacgcttgacgttcagctatcaagcaagccaatatcattacacgccaccgccgctctagtctagaaacagagctgctatttcaaaacactgcccatataaccggcaacgaaacagccatctgtatagccatagacgagtacaaccatcaccaagttgtacacatccatagtgactacaagtacacacgatagacacattcttctcacctgtagctatggtattgctgtgtgcaccttatcacatagatcactcgaccgcctagccacctcctgtccctttttagtacacgggctattttaacgagaaataaacatttaccacttccacttccctgtctcggaccatcttcacgttcacacaatctccggctgcacttgccccgcgcaaaataatccgtaagtaccccggatatgcccctccacatttgctatgtgtagccccaaataaactaccagtaaaagcacaagcacaccggccacaacacctcaaaagcagggccgtaaactctatcgcccacactactcggacttgtactgtagagcaacaggcacatacaacaccctttactatacgccatataattaattagataacaaactaaactctccttacatcatgtcctgctcgtcgtagaactcgccctcttcgtcgtcgacctgagcctcctggtactgctggtattcgcagacaagatcgttcatgttagactcagcctcgctgaattccatctcgtccataccctcgctggtgtaccagtgcaagaaggcctttcgtcggaacatggctgaaaactggtcaccgactcgcttgaacagctcctggatagaggtggagtttccaacaaaggttccggacatgggcagacccttgggtggctgggaacacacagcagtctgcacattgtgagggatccactcgacaaagtagttggagtttcgggtctggacagacagcatctggtcctcaacctccttgacggagacctttcctcggaagaaggcggcggcggtcaggtatcggccgtgcttggggtccgaagcagccatcatgtttcgagaatcaaacatctgctgggtgagctcggggacggacagagatcggaagttagcggacttgagagatgtgagaggagcgtagccgaccatgaagaaatggagtcgggggaagggcaccaggttgacggcgagctttcgcagatcggagttgagctggccggggtatcggagacaagtggtgacaccagacatgacagaggagaccaggtggttgaggtcgccgtagacggggtgtggcagctgcagggttcgcatgcaaatgtcgtaaagggcctcgttatcgatacagaaggtctcgtcggagtgctcgaccagctggtggaccgacagggtggcgttgtagggctcgacaactgtgtcggacaccttgggcgaggggacaacggagaaagtggccatcattcgctcggggaactcctctcggatcttggcgatcatcagggtacccataccagaaccggtacctccacccagagagtgcgtgatctggaaaccctggagcgagtcacagttctcggcctcacgtcgcacaacatcgagaacctggtcgacaagctcagcgccctcagtgtagtgacccttggcccagttgttaccagcggaagactggccaaagacaaagttatcaggtcggaaaagctccccgtaaggaccgcccttgacagcgtccatggtgccgggctcaagatcaacaagaacggctcggggaacgtacttgttggcagcagcctcgttgtagtagacgttgagtcgctctcgctgaatatcctcctcgccgccgtagactccgtcggctccgatgccgtgctcgccggagatggtctgccagaaagcagaaccgatctggttaccgcactggccgatggatagatggacaatttctcgcatctgtgttagcaaaaagtagctgggtcgtgtttgcgctgtggtacgttgtggtggcacgataatatgttgggaggtgctgtcctgtgcgtgctgtggtgtgctgtaagcatagaataatatctcctgaatttgtttgtagaccgccagaaggacgtgttatctcgtgattgtggacgtgttatgggtttaaaacttcatccaatgaagtcggacctcaccgcaggtcttctgtatacacaatcgtcgatatacgtgtctgtgtctgtgtcgttgtctctcctgaatgccaccacattgaccaattcgcatcatccataaataggggtcgtattattccccaccatcaacatatctgtgacattcggtagactcgcctatcaacacaagcaacaaggctctcagccagcagcagacaacacctctgtcgctatctcgtctctaggttgtgaatcacgggccaacggtccatgtcaagggggggcgtgacgctcaaaaaccgcacaacagcttccgccaatcggaaaaatcgcccgcttgtgcgtctagcaacaccattctcgtctcgcctggtactcactgggtatctgtatgtgtcgtggagtggttgtgatggacaggagtttttctgcttgtgcccctaatcttgaaaacgcgtaaataagattagtgttgtttacgctgccggttgtctgggagacgcgtgttacccggaagtgttggttctcttagggaagctagcccttatacacttccttattgggaccatgcatcgatcactgtttagaggcaacgtgtaaagggggtggtcctggtttggacagcggggatggatgatgtgtgatggttttgaggttgcaagtaaagggctgtaactgaagaggacatagccgtgttaaattccggtcctgaaatatctttcaagatgaatctagggctacataatggaactggtcacgtgttgcacataaatacgagcgtggtgccaaatatggtttctagtccctgactgtactctggtggctgtaatgataagaggatgaggaattacagtaatagctatatactcgtagctatggtaaaagctacagtatgatgacgattagagagacctgtgaataccgagagaaactggtttgtatcttgtgtccctgctcttagtcagaatatgtcacagtagtttgcgatgatcagcgaatttggatgtatcacttggtatcgacacaacagagagaaacaaaacacgatgtagacagtgaatttgacagctcatgttttgtcatacgtgttcagatactgtgcaaggacacagcgtcataaagcaatgtcgtgggatacgactactgtattataaacggcccacaggtatactgtacgagtagtcttaaccccgcacatcttgcccgtttggtggtcctgggcttatgactagggattacgattgaagagatggttcaaggtttgagtgatgttgcactttgtagagagacattgagaacggacttgtgcggactcgtatgtactcgtactgtacttgtgagatactgctaaataaattaagtatgacggatggttatatgtctatagtcattgaaacttatcacttgagagtcgcttacaggtatacatgtcccctcatcgtcagtcttgacataactggagctacacatccgctccctcatattttcctgctcttagcacacgatattgtatgtacgagtggacactaatacagcaaagagcgggcgcagcacgacttggcagtatccgttgtctactcgtacttgtagtagtcgcgataatgatttgagaggttgcttacaagcggcttggggacaaataatgaacagtcgcaacgagacaaagaccgacaatattacctcgcgagaaaacggcgaatatttccatcaatctctggcatgcagttgtcgtgggggttgactttgcgctgcaggaccgagcaaattcaccaaatcttctcttggcgtgggcctgacaaaattcgctcccctctttttcggaatagaccgggctgtggcgggtttgaccggaaggagtagacgtagcaacaagttgaaaaaaaaagtacatttttcgtgccactacatgcccttgtacgagcacatacaaatttgaaccgcattgaacatgggacaaactacaagtagcggtgagtatgtaagaggcacgtattggacggcaatatatgtacggtagtattcgtacctacatttgcgctaagtgccgccgtccacctacatacgatacatgtatacgtccacaggctgtaggtggtacctggtgctaatacatttatatgcatttaaacgggcataaaatagatgtattacattcgggggaactccatgggctcttgttgcacgaaaaagtgtgactcaacaagggtctcatctgcctaaaacagagcactcatgcagacaaccgacatcatgtgcgtatgccaagccgacggtactgtgtttttcccaatcaaatacgttaagtggacaaggccatatctcatgccagatcctggtccctttctatataagagatgatctggcacattagcatgggcttctataacttcaacagcgaccttcgtcaccattattgcccggggccaataaaattaagcactaagataaagactgcggctgatacctgatgagaccaagcatagactaaagcagcaaaaaagggaccataatactagtattcaaccaaatcagcagttgcggcagtttcaacattacacgttctttgaacttttataagagcccagagcctttcgcttcattctcttctttttctacgacacagccatctccacaatgagactggtttcatttctcccattattgctgatccacacgacagcagcgacgtcagcagataccacagcagtagatttgtcagacttctacgcaggaacaaatcctagtgcacttgattcggctatttcagtgcccgagggaaattacaagcccaaacacgtggttcacatttccagacgacgtctgatatgcagaaccaacgaagatacaggagaagaaatctgcaaggtggacaattccgacccccaggaatcaatcatcgaagaagttgattgttccaagaaggagagaaacaccaatgttggtctcagagtaggtgctctgtttgctgtgctcggtacttctgctctgggcgtgttccctccagtgctggctgaatccatctggagaatcaatctcgaaactctccctatgaccttcatcaaacagtttggcacaggtgtcgttctgtccactgcattcgttcatctaggagctgaggctaccgaagagttcaacaacccctgcatcggagaggttgagtacaagcctactcccctggcctttgtgctggctggcctcttcatctccttcctcattgaatacctcggagcccgtcttttgagatggagagcaaacaccctagaggctcgacgaaacgagaaccaagactgcgaggagaccaagtgcggacatgatcacgaccacggccatattattgacaacactggaggagacactgaggactctgacaatgggggagaacccgttcaagagattgtcgaagatgttattgaaaaggctccctctcgtctctcttcctcttctgtcagaagaagtactactcagacaactgctccccctcctcctatcgccggcggatgccactcccacggtctcattgaccccactgataagttttccgtctggattatggaggcaggtatcattttccactctgttctggttggagtcaccgtctctcttgctgaggaggacaccttcatcaccttgtttattgccattctgttccaccaaatgttcgagggtgttggtctagggtcgcgtattgctggcctgaaggagtctcgcctcatttccaagtgcctcatgtgcttgtggttctccatcatcacccccatcggcatggccattggtcttggcgtgcttgaccactttgaagagaaccctaccactctgtgggctctcggtagtatcgacggtctctgttgcggagttttggtgtacgctggtgttgtagagatgttaggctttgactggctgtttggtgacctccaagatgctcctcctcttcgagtctgcgttggccttgtcgggctcactctcggaatgctgctcatgtccctggttggacactgggcctaacactgtcgtcatacatgtgttacaggtatatgacgaataaaataaaaaacatagatatttaattgcatgaatagttcattggaagtgatgagtgtaggtcaatttgtaattatgtgatatcatcatacaccccaactaacatactgtaatgtacgctaccctgagtacagtacaagtacaataacattagttcagcggtacagtgaaaaccgtttattcaataaatagcgccggaggtcggctatgtcgtaagattctcctttcttctaaccttttttgtgtgtacagtaacgtaatatcgtaccttttaggcaaagtagatgccagctttgtggaactcattcagcagagtgagaaactcggtctggtcacactttgcggatcgcatttctccgatgccggtgtcggtgagaatcttgttgatcttctgcttgacaacgtcagagaggttggatccctcaggaatgatctcgccctgggtggagagccaggtctggtagttcttctcgagaactgccagaacagcgctggtcttgaagccggcgttgatagtcttgttctttcgaacgaaacagactcgcagaagaccatcccactcgttgaagtcgataggaggccgggggttcttgacctcaatcttgacgaccgaagactcaacattgggaggaggtcgaaagttacctcggccgaccttcatgacgtgagaaaccttggcccacatctgcacattgacagacagtcggcagtacagagaatcaccgggtcgagccagaagacgcatggcaaactcgtgctggaacatcagcactgacactcgcgggggtcgaggctggttcagcagcttgaaaaccaggggagaagaaatctggtaaggtgtgttggaaatgcaaacgtcaaagtaaggaagctctgtcttaatacagtctcccagcatgatttccagtttcttctgctcaggcttgccctgcactcgcttggtcagctcggcagccattcgaggatccatctccacagcaatcacctttcgagccttctcgagaattcgaacagtcaggttaccagtaccgggaccgacctccagaacggtatcactgggcttaatgtcggacttgtcgacaataccctgggccaccagagggtttttaagaatatgctgaccgagatcagtgttcattttgaagacggcagtctttcgctgctcgccgcctgcagactccctctgggcgcctccggagaacttctttgctggtgccttggccattttcttatgctgttgtatagtggtttgtgaactgaaaaaaaagatccaaaatttattttcgattcatgcatgcagaaaaagctaactggcatggcactgagcatgcacaaagaatcgcccccagaagtgccttaataatcaaagaagattgttttgagcgtttcctttgcaaacacccgattttgttagaatggcatacttttaatcagcccttccccaaacatcaagttcacaatgtaactccaactaactcttaacctatcagaatgtagagatatgcaagattgtgacatggtagaataagcatcacatcaacacaatacaatggccaagagaatcagccgacccacaaatctgaagagcaaaccacgacctctgccagtcgacatgctggttcctgccgacaaggctcgagggtgagttgaaggagggaggtgcaataagagagcagtattgatgatctggagtgtacacagaccttgccacagcgacacagatacgatgaacgtaccgctctagagaaccaacactagagcttgaagcttttttgtttactggtttttgcctcacagtcgcgccataggatcttggtatatagacgctaccacagtcttgtgatacactgcggtacacttgtgctaagcttgggtgaactgtgttttgacattgctctcattattcgacttctaacacagattcaagatgatcctgctgtcgctcccttttgtggtcctctcgtcagtcattctctacaagcgtctatacatgggagaggacaagcgcgttcagattggtgaacagacagaggagggcatccgatggttcacgcctgaggagattaagaagaaggacgaagaaaagatcttcaccaaggtctttggaaatgaagactggctcaagaacagcaggactaacaactaatccacccacatattcgtctgtattctgtatataatatatatttttcgatgctatagaaatggtgtgtatacgtagcactgccagagcgctttgaaaactgtagaattgaaaaaagatccatatccctcggtactgtacctgtacctcatcaacaatcctcctggtcaaaggctttgtgtgatttgtagtcaaggggacgacctcctgtcacacttagaatcaaagccttaagctacgtccccaccataggccacggtcaacgcgatctatggttgagaattcctaccggaccactggtttggcgatacgcacgccagcgttggcaagagacataccatcacgagaagaagcacctctaatgccttcccgagacactcgtccagagtggtacgagttgtatccttctcttgacactgctcgaggagtactgggaggcatcagagattgacgcttcacaggtgaagggagaaaggagcttcggcgactgttgctgcttgtgctggactcgctacgtcgcctagaggcgtcggtcaggacgggggtgtcgctaaccgaccgcatacctgaaagaccggcagctccagttcctgagtaactcagacgaggctttcgagtaggagtagccaagggggtcgcgtaggagcctagtctagatgacgatcggctggcaggccggtttggagaaggtaggggaatgagagactgtctgcttgaaccgttaggctgaagagaaggagtctcacctagcttcactgtagaagtagaaccgatagatgatccaaaagacgtatcggaacaagatgatagcgagcagatggatgctgaatcgggagtggaaggtttgctgcccagttgggggtatctgtggagcagtctgtttggagagttagtaacgggaatgaaagatttagttgtcttgagacttctaaacttgttgaaaatggcagcattgggaatgggtccgctgttgcagccacactttgagtccttagagtccctcaaagtggtcccttcgcctagagaagctgtaggagactcaatagactccaacgtctccatgatgacactcatatcatgcaacggagacttcttgtgtgaactggtggatggaggcaactgaatgtctttgagaggtaccactggctccgatgcctccagtgcgtctgagtcaggtgtagacacaatcactgacgaagaagaagagttggataaatcagaagaggatatgtttgcatagtcgtttcgctcctgaagctgtttgtcgctttcaatttgctggttcaatttgctgctgtcgatatctcgaagtacgtgattctcgctggttgagtgtcgtttgatcacaggcttgggtgagaatctgtccagagacacaactcgcatatgcagtcttctattgacgggaaactggggtgcgaatgacagccgtggcgagatggctccatgatccgatatctctgtggtttcagagcactcggagaagattgacgagttggtagacagtctcttagtcgatagaaccttaacttcctccacaaacatgttcttgtcgttgcagactcgctggagaacagtcagtaatgccgcgtcgagatcttcaccgagctggtcgatggccaactgcagaatcgaagaccatttcttggtcgacaactcctcattcaccaatgcaaactcccccttaagattgtgccactgctgttccagattggtccagttcatgttcaccagagatgaaaatgtcgggaaaatgggctcacatctggaagagaactgggccaccctctcgggaatgaaaccgagagacacagtcagcggcttaatcttggtatcgttgagttgacagaaggtctccttgatacttttgtcctgacgagtcaaccaagggtatacttctttggccacatggtcgagttgggatgcagaaatctgccctgtgaaactagactcgagccgtttctccttgatctcaaagaccgtgctcatgcattgactaatttccgcgtcgatatgtccaatcacttgttcacacagctcagtgtactcaatagccacttccatctggtgacacagtgtcgcgattccctccaacctttctttgtcgtgatctgtatcctccgcattgtgtccatcattgttgtcgatatcatcctcgttccctgctgctaatacaaccagccttggtgtgtctttgaccaatgccacaagccttggtaacaggtctgtatgttccaaaaaccactctccttcagaggagctattcttaagaactggttccagcgtggccttgcgctgattgacgaactcatgcaagccaatcgatgatggtctaacatagtcgatatcccaagtttcccatccattcagtcgaacaaaatcgtctctctgcttctcgagattggaagcacacgtggatagcatgttataagtgtttgtgtcgtgcaattaccatgaaactggctgtcgatagcgtactatggctgaagtacgcttgctattgctattacttgtcgagtgtcaagtgtcgagtggagtgtcgagtgtttgtttaacgtgtgtgtgtagtgtctgtgtggtggagcgctgtccgagtggtgttgcaatgtcctagtggcctgaaatgccgtgctgccctcttatgttcaccctgtgttatgacacgtctgatagatatgtggttgagatatcagttggtatgtaaaccagctctctggtaacgttatgtacgccagcacttggagtgcatgtttcatgcttcattgcattctgcctctgggacaatctaaacatacgaaaccttggaagggaatatgtaaacatagcgaacacaaaacatagcaattgtgtatgcaggtcagtgtcaagtacatgaataataatattgaatcccaacctcaaacacatgaaacagacccacatatcaccatctatttaccttgggtatcacacactatgtatagctgactgctcatgctgtacagtgcggctgcctttacagtctccccggcaacggaccttaggctgtatcacttaaagttgagtctaaaaatcgcccacaaagaagtcaagaatgttccggttgacaataatattctgccatatgccccatccccttcaccctgcctaagaaagtacagccccaaacgcgctgggcggttcacgtatattgtaaatacacgaacctccttctatgtaggggcttctctccaggaaaaaacatggcctgtctacagttggcatgtgtgcaccctaatcccaagaacgcactcagagagggtgtacatatgtcaactatgttatcaccgaaaaatatcattacttgtacgtcacaataccatatctccttttttagttagcaatttcatctcgtctccatccgacacttcggaatgtagtcaagtccttagaaggttgcggtcgcccgttgtcaatgacgagcgcaaacgggtttcgatcggaggtctggtgcagatttccgaaagtgtgattcacttcacaatgcttagcttcgtcggcccgcacatattggattaaatcacgcatggtacagtcgtcctccatatgccagtaggttctggcgatgtcaggaacttccatcgatgcgagctccggcagacgtccggcgtcaatgtcttccagacacctggtgtaggtgatgacagcctcttcctcaaggtagcccacgaaccgatgacaggttgcgggggagatcaagtaagatatgaagaagaggttgtagaagatgatctgaccgatcaggagcccagtgcgcatctgtacactaggcttctgtagcttcaagaatgtcagaagatgcattctctcattgtaagcttcctcaaccagagactcgatccaggctctatcacgtctcaaggcacgtagcgagtgaaggtgtctgatcatcccggccaccattccgggaactccagcaatggactctagaaacaggaatctgtctagccactgtctggtggtcatacggaactttggtagatgggcttccccttcttttgggtgcttgtagccggtgcataagtcgaaaatgattctcatgaggagaatagctctcagggcgacccggtcggaaaacgtctcagtctttcgatgattgacctcgagagcgtccatctgctccttggtgtagactggatggatccaagcggagcctgtgaagtactcatggtggtgcgatgaggtagcgtagagagacacgtcatcgggtttggagttagccattgtgacaacggaagcagcagtggatccataggctgaagtggtatcagtagcgagctcagttgaaggattattctcgtcttcatcgtccgtcgatctgaaccgtcccagaaggtttggggctcgagcattgacataggtctggcctcggttggcccagtctctgacagtcatgatatgtcgtggatttgtgcgtactttaagaaggtgaaattagagaaaatgggcttttgttatataagatggatgtggttttgtgtcccttacatcatgtacagtaattatcacagtgatgggttttgagttccttatccacagcttaattttcacctgacggacatcacgcgaagagagtgacagggacgtgaggttaatcttccgagtttgaatttgacatactgtaacaacatattattgaatttgcagagcccttgaactattacgggatagtcgttccacgtgatccctccatgtgccacattatagggcatgatatctgcgcagtttcactttttgcagattatgcaccaccgttatatgtgcatggagatggagcatctggcagggcttgtatgtatactttagggaagcgagatgcaggattcttacaactgcgcactgggctacaatacatgtactctaggtactgtagctactgtcatggggaaaaatcaaaccgcgtagcagtgatacaccgattcacgtgccagaatcttgtggaataggaacaaatctggtgcgagttcgtgttgcttgtgagactcaggggtacaagtatgagtacggtgcaagtggctaaggggcaggtattcgagctagaataagtcactagatgtaccactactcgcaccactacgtctctgctttaatctacactgttttagaggttctataatgctgtattttttatgtgttatagaccaattagttggcctcatgcaagtcacgttggggactgaataaataagtgttgaaaataaatacatcaccactgggtgatttcgacctcggcctcaccaaacagcgatgacttgcccagctcgcccaccttggcctcctcccaggagacgccgttggtgttgataatgtcgggcacgttggcggccaggaactcgacaatctccttgttaatgagagcaaagtccagcaggaaggcgtcgtggccctcaggcgagtcgatggtaaccaggtgcgagttcttaacgtttgcggcaatgagttcctgctcagcgaatgtgaaaagtccgtcagacttaataccaatgataagagcgttctgctcgagagtctggagagcagcctcaacagattcggctctctctcgagacacatcatgagtgtccagctttctggtgattgcgatgtagcagttggcgtcgaatcgctttgtgaacttgtccgattggtatcggaggtagttttgggctgagaagtgggtgggtggcttcttcttgacagcaagaggaacaaacgaagacgaagaagagacagaagatgtatcgtcgagaatggaaccgttggtgctcacgctagagggctgagaaacaccgttggcagtgggagtggagctaccttcttcatcggccatcttctttcctcgcatgtgaccgtcgttgtgaatgagccaatgctcctcagaagcagtctgaggacctcgtcgttggggtccgttaattgtcttatgtcgagttgggtcgggcgtgtctcgtccaaacttgttttcaaacgagtctctggatcggtaggtcagcagagcagccattcgagcggctccgaggcccgaggagggcggatcttcaaacgagtagtacccgtcgtcgtacttggggtccgaataaatgcactgccgctgggcctctccccaggaaatgcaccaggctgagtgtcgagccgaagtggcgagcgccacaaaggtccgcacgtagtccttaccgaaaaaggcgtactccagcgtcagcatgccgcccatagatcctccaatgcaacaggcgatctgcttgattcctaggtcgtccagcaccagtctgtggatgttaacgtcatctcgaacggtcaccagtgggaactcggggccgtagtatgtgttcttatcagctccgggggtgttgtcagcggtgcaaggagaagccgaaccgtagggtgatccgagggagttgagacacacaatgaagaatcgggtgggatcgaacgctcggccagggccaataagagggccccaccagtcggagacgtcagcggaaccggtaagagcgtggcaaataaccatggcgttatttccagcttcattcagaactccccacgtcttgtaggcgataggaacattgtagatagtgactccggactctagttggtattcgggaacatgggcgatttcctggtccgagaccagtcccgagaaggggttttctttgactactttagtccgtcggaatttcatgatggttgtagaagaagatgaaaagatgtgaaagtgagcttctgtacccaaatcagctaggactattggtttaccagtggagaataacagatgacccgggtccttatgcgagtctatgtgtgacctgaaagcttgttgcacagctgaaagatttgagcagtgtagtggcgagtaacccaaattttgtgtaggcgaaaatgcgacgttaatgacaagtaacactcggtggcagcccagttatatacatgtttagctgcctaacaacctagattatttgtgtttgacgttgatcaactccctaccttgcacctgaggctttttgtctcatctttcacctccgccccagagtttcttgctctccgcacctgtacaatgacatgcagttcatcggcctgtcttcattgtgttataagtgtggcttgcatatcacgtgcgattagaaaaccaacgactacttatctcccaatcacaccgtccttaggttgtggctcagagctcgcaaaacccagacccaagccacacaggtgcagaagcccacgtcttagaggtgttctccagtatttcccggcggagttggtggactttttttctcgcgagtttggcagcaaggtggaggacttgtacttcaatgggttatagaggctcactacgatagttgtcatagccattgccatacgtccctcaaggagggggaagaacaagagcaaaagttgccctatatagacggtcataggatccaccatacaacgcttgtagttatagccacacgaagactccttcagacgagatgcgctccagaaccggaatggcttacaagggtcaacattggacggggaaaaaataataatatcgtcaataatgtccaaaagaggaccaattccaaaaagtctgaaagaaagcttcccctgcctaacattcttggcttgaagattcatgtttcacgattcacaaagtgagaggtgtggctgctagcacgtgttgagggagttagcggaaagctagtcttgtgtggcggggcagattagaccttggtgaaggccctgatacgagcagcgccgaggtgttttccaatgtggtatgccttgtccagatacttgtacttatttctgtatgtatcgtacttttgcctgacccttgttattcttgtgtgtagtatctgcacttacaattgaccggtcaccggtccgaagccgcttcgggatactcagagattagcattgactcaatcttaaaacatacagtacatgttgacgaataatttcttgtactcgcacttgtagctaccagtaccgtaaatcacattgaaaaaagccacctttcccgagtgttgattcctctactacggaggtacgaacatggaaatttttgatcgcaacgttgaattgttttacaacgtgttctcggaccacggccgaaggtggcaaacagtaaaaccagtactattgcgtgtttagcgggaatcgaaccaagggtgtatagcgtttgtatcaactcggcttagtaatcacgggctaaatatgatacatctgacatgcacgatttttgagatttcaaggatcatctaaacgacggtggccacgacaatcatcagtatacacagggggcatgtcaagaacaaggatacaatacaaggcgccggtagagaagcatgtcaaggagcaaaacctgccgtgcggcgtggatgtggttttcccttcaaatggatcgctacaatcgtcagtggagactctgattgaacagtacagcaaggagctgaagagctacacagtcaaagggcctctcagcatgtttttcgcacctcgagaagatgggtcgagtttctctgcgtctgtattccaaaaatccgatgcctggatcatctccaaaagccggatcgactcggacaatgtatttgcagtatggagaggaaacgttcacatgagtctgacgagatcgacctaccagacttctggtttgaacggaaagaagtcgcgctacggagacaaatacctcatttcgttcaacttgcgaaacccaaacttccatattggtaccaaacaacacaaccgatttctgtttggcttggaacagctggacaaactgcaccctgacttggagtattctgtgacagttcatgccaatgacgccagatatgtctccgagtatctttccaatgtcaaagaggtgcctctcaaaactacagtctccgagagaaacgtacttgtaccttccatgactcctccagtggtccctgaactcacagacgcccattctggtgccaaggtggacgtgtctcagaaatatagggaccatctgtttgagagctgggctctgggactccaagaatgggtagggctggcttcaattggagcaggccggattgcatcggatgataacgtgaataatctcttcagccagtaccaggttgaagatggccaacctgcaaatgttacaaatatccaggtggttgggatgtgtcctcttttggcatccaagctcaagatactaggggagcaaaccaatgccccattctttgcattcactgtctacggtgttcaagacacgccctactcgtgggacaacaaggagcaccagtatgacaatggcggcgaaaatgattacaccattattgacattggagacgatgtattgtcattcgaaacagtaggacacagcgacatgtacatttaattgcattacatcattctcataattaaataccacttatttgtagctatcagttactttcctaatcagtatttccccttaaaattttctcataatcggatatcgttactatatacatcattattcattatgcttgcttggtgcaaagatccaaagagtctaaagtctagctagttggtctagttcttgataagattgcctctgttttcctcaatatccttggcttcctcctcggaaatctcggactcaatctcgccctcaatggtggccttttctccctcggtgatcttgggctcagcaacctcctcctcctccttggctcgcaggagattagacagggcagagtcgtggttggcgtagagctcggtgaacttgccctgctcagcgacagtaccttcgttggagagaacgatgactcgatcagctcgtttgatggtggacagtcggtgggcaatggagatggtagtggaattgccatccatgagtcgctgcagagcctcgttaacagaggactcggaatcggtatccagagcagaggtggcttcgtccaaaatcagaatagctgggttcttaatcagagctcgtgcaatggcaattcgctgcttctggcctccagacaactgggttcctcgagctccaacctgggtgtcaataccctgggggaagtcggccaggaacgtgcaattagcctttcgagcagcttcaatgatctcatctcgggtagcctccggctttccgtatctgatgttggaggcaattgtgccagaaaagagaacaggttcctgggacaccacaccaatctgttttcgcaacgatctaacgttgaaatctcgaatgttgttgcctccaatgctaatgtaacccttggtggggtcgtagaatcgcaacagcaaggaggtgatggtggattttcctcctccagaaggaccgacaatacagacgttggaaccagcggggatggagaagttgagatcggtgaaaataggcagagagggacgggtggggtaggcaaaggcgacatggttgaagtcaatgttgcctcgggcagactccagatgggggcccttagtggcgttgatggcaggctctcggtcgttcagttcaaacagacgagaggcagcaccagcacccttcatgagctccgagtagaaagacgagacggagtgcatggctcctcctgtgtatccagcatacagcatgaaggaggtgaggtctcccagagatagttggccagtagataccatttgagaacccataactagaagagccaaaatggtcatgtttccagacagagagaagaagccatggaacattccgttggccatagcatccttcttaccaatgtcaaacacggcacgaatcttggagttgtacagccgtacctcctggatttctcctccaaaggactgggccgttctaatattaccaagacgttcctctgataccttagtcagaccaccgacggcggtctggagctctcgagagatatgtcgaagcttctttccgtagataaccgcgataatagccacgggaggggctaccagcatcatgaacgtggcgagtttgagagagacgtaggacatcattccgagtccaacgacaccggagatgatagatcgtacaccgtcggacatgttgttggtgacagatttggccacgacctgggcgtccgtagacagacgcgaaatcaggtctccgactcggttggcatcgaaaaactctgcgtcctgagtcacggttcgcttgtacagctgagctcgaagacgggcagacagacgttcggaaatgactcgcaggcagtagactcggcccatattgcacatggctccgatgatgaacagacctccaagggcaatgtagaactgcttcaacggcagtccgaaaacctttcgttggtcggcatcctctgggtccttttcgtcctcggaaacaacatccatgatcttaccaatggagaggggcacggtcatggagatagcggccgacaggaacagcagcgtgaaagctccaatgagcggccacacctcgtccttcacgagtcggaagagccggaaaatgtctccaactccctggttcttgtcagaattacgggacgtgagttttgcttggagattgatgtcgccagcagccttggctcgctcggaaggagacacgttcacgggagtcgcgtcatcgtcggagatacctttggacttgttctgattgaggattgggaggtacgaagagaagggtcgagcggcaagtgtagggtagacggagggcgaagagggtcgcagaaagagggatcggacaggcagaggccgtaatggcgatctagcgtgccacagaggactcagtcgggccactctcgggagcatggtggatgtgtgggattccggattctggagacaaaatgggtgtaaatgttattttcgggtgagagttgcatgtgcgtctgccgctcgctcagtgttgggtggctggaatgggtgttttttggggtaaagatgcgagcgtgaaagacacgtttgagacattgaagagtgtatggacagcgagttggttctatatataaagagccttcttctacccgacattatctactacttccgccacccctatataattatagatcagtccaaaggcttgttaataatgttagttggtctgggggtgactaagtttgcggttttcaaccccgactattccgaagcgactgaagctctgagggacagtgtgacgttacacgtggtggtggttaaaaacacgacgcaatcacgattacgatacgtgatgaatattgtgattagtcagtatgggctagaaacgcataatttacaggcgcaagtacaacaaaccccaatcacagctacaatactgtactcccgtcccatgtctaccatatcccagacccaaacccttcactcaactccaccacccaaccaatactcctccactttctcgttttaaaaagtcatttattcatttcatgattcgtctatttcttgtagatcttgacgtcaccctctgttgttagtattgtcgcttgattgattcgcattctccttctctctctcaaatactcacgctttccagactcccacttggcgaccttaatctcagagagatctcgggcgttgacatgggctcgcttctgctcggtaagggcctttcggacggttcgagcagcaatggcagagtacttgttgaagctgggttagtatgtgtctttgaatcgctaatgtgtgctgtgtcgtgggtgctggtgttcatggacatgagtcggacatgggtcggacagccgaaaaaacagcaattcggaacgcaatcagtccatcagcgcaattggcgagtcattgcaccccgttcgatggtactcacgaaaaaccggcagacttccaggcagacattgtgtggtgttgttttctgagaagggtgatgtagtgttggaggctttttgcagatggcggttgggagacgtggttggtgctgtaatgttcagcgcaatacgcatataaagagtaaaacaaggaccgtattaagtaagctccctgacccaaaggaccttattgaaagttctgtcgttaggctcgctctgcgccaactctaataatttttggtcaaatgtacatagaaacggtgcagtaaatatacacaacagtactaccgttcgacgaccgacaaatcatggcatcagaacgacctgaccaggagtacattgacactttctggaaattgtcttccaacgacccggaggagcgagtggagggctgcaaggagcttatttcgaccacggatagtgatgtcaagtggaactatggtatcaagagactgatcaagggtctggcatcgcccaagcccagtgcccgacttggattctctactgccctcacagagtttgtgtctctcccctacggtctgactgtggacggctactttgatttgctcaatgagcaccttcctttggcctctggtatgaagaccaaagagatcagaaacactcttcttgggcggctttttggcattcaggctatttccggctcccagttgcttcgaattgacgactccgagggattccagcggttcatcgactacgccgttgagattagtgtcaagaaggcctggcttcgagagctcgccttctttgccattgtgcagttcatcaagcgagagctgggctccaaaaagaaactcgccgacaagagctacatcattgagaagttgaaggacaccaaactggacaagacccctgaggctgttgctgtttacctcactattggtggtgaagaatgggaccctctggcaaaaaacaatgctgttgagctcggaaagatcctcaaggatgtttcttccccccaggatgatgataactccaagcagaagggaaactggtcgcccaagcccaactttgtgtggcccatgatcctgcagattctatctgaggacgaggtggaggaagtcaaggaaagcaaaaagagcaagaaggacgacaagaagaaggacaagaagaaggataagaagaaggaggagatcaaggatgattctgagcgaatcactctgcctgtattctggaacattgtggttgaccagtctctgttttcccagtctgcatctcctgagcgaaagtactggggcttcgaaattcttcagctcgcccttggtattgtgagcaaggacaaggtcggcattcttctgtctcccaaccttctgcgaacattgatcaaccagctcggttcttctgatagactgctgaacaaggctgcaaagcacgtggtgactaagttgtgtgagcttgcacccactcctgttggccctgagatcattaaggctcttttgctcaaccccggtggatctctcaactttgaccgactcaccaagaccaagaccattcacaacatgctcgctaacattgacacttctgctgtccccaccattatcgagcttctcaaacaagtgttcattgctcctgaggagaaggctggaaaagcacttgatggcaagcgacagtgggctttggaccagatgcttggcctggttcgacgattccaggtcgaagctcttgccaacgctgacgtcgactggattgacgagatcatcaagttcatgatccgatggggtttcttcaaagacaacagtggcaagaagcgaaagcatgatgagtctgactttgtgcccctctctcacaggacagtcaaagattgtcttggccggttcaattcagtgctctcctctgttcttaatactgctcgacccgacagcaacacatgggcctactccgcctggaactaccttagtggtatgatgtctgagtatgagctgatctacgatattggacagtccacaaagggcgagaaaagtggtgatgaggatgaggacgaagatgatgatgaggatgatgaggatgatgaggatgctatggaggttgatgctggcgaggaagttactgagatcaaggacaagagtgtcaagactctcgacaagatcagacaccttcgactgtctcctcacggtgacaacgctcttctcaagtcgtttgaggttctattctcgcttgttctcctgcaactctaccaacaggatgaggagtctattggtgtcctcagtgatctgctggagtgctacggtaagattcgagaggaggacgacgaggttcttacagatatcattgtttctttcatttcgcgacgatctgctcttctgaaaaagatggttgacgtcgtttgggagggtttggttctcgagaacaaggtcaacatgcagcttgtgtttgacgttcttaaaaccgaggagaacgtcaagggtcaggaaaagctttttggtgaggagggcgaggaagatgaggatgaggaggacgaggacgaaattgagcgagctaacgctgccatgggcaatgatgacagtgatgacgacgaagaggatgccgacggtgaggacaacgattctgacgattctgatgattcggactcggactcggactcggactctgattctgattctgaatccaactctctttcgcataacgacatctctgaggccgatcgaaagcttactcttgctctctctgaggctcttggaaccaaggaagaggaagatgcctctgataacgacacagactcctctatggatgacgaccaaatgcttgctcttgacagccagcttgctaccatcttcaaggagcgagcccaggttgagggagacaaggagaatggcaagaaagttcttacaaagaaccagcagaagaagaaggacgctgccgaggccaaggagtctattgttcagtttaagcacaaggctctggatctcattgccgtctacctcaagtcctacgttaaccgagagtggggtcttgagatttttgagtgtggttttattctgctcgatctggttggagctactaaggaccgagctctttccgacaagacccagaccgttctcaagcagcgcctctacaagctgcggtaccaaaactttgtggccgaggatgccgagagcgagctagaggagcttctcgccaaatgtcacgatcaagccttggctgcatcaaacccaggacacgctaatgtgcttgcaggcatgtccatgctggtgtccaaagctcttgaggaccgtggtcagatcgagcaggtggtgcgacagtatggtgacaccatgctcgaatggatcaacaagcccaagagcaagctcggacccaacatgttctttgatcttgccaactgggccggagacctacgaaagcgggccaaggaggtcaagaaggctcaagttgagcttaccgagaccatcaacgaggagatggccgagaaggaggaggaaaacaatgagtaagggagtttgttgtataaaaagtaattattaatggatattattagtatggatgaactgaggctggccttctcaacaagatgataaccgcgctcatatgcaacacgcttctgcttcagggaagtgcttgcgcctacgtcagccagtcgctttgaatatgtacagttacagtactcaaaactgatgttacatgagctacttgtagctatctacacaccggtttttcctacagtaaatgttcgctcgctgtaacatactgtagtgtattacaactacagtgcgagcctacttggtgcacacctgtaggtaagtcgcccagccttgtaactcattaaactacagtaacgtctatgatatcgaagctttataatcattcggcaggtatgtattgtgtatcacacacattgacaaaaacatcagatttcattgcataactgagatttattcatttctcggagattttttgactaatgcaagtgagcatgaaacctccgacattgcaacccatgcagtggcgctagcttgaatccgggcttgcgcctcacttgtgatgcgtttctgcggggattaacgcgagagctcttcatactacaaaaacatactgtaacattgagatacgaagagcaaaatttttcatgtgtgatccttgtacgtgtatgcacaggcgctttatagagactatggtatgactaaaggaaccgttggggtttgctttagtgtacacaaaccagtgcgagtagctagctaatcccctggtagtgctgtctattttgatggatgccgaggaatttaccacagactgcatgttctcgaggtggtgccacactggggtcaacaaagaaggtcctcttacatcatgcgcttttgggactcactactgttcaatattctctagtatagtctgtgcctaaagcaaataatatgcgctagtaccggttttgttaattagtgcattcattactcgtataaatatttatagatggtcaaaaaagtacactggttgcgtcttcatgcatcttgctcttcaagatactcgcactcagattgctcaattgcctttgtgaagaggtaggagtttcgtgtggtaagtgtgagatcttccatgactcgcgaaacctgggatttggtacctgtgatgattagttgtatctgttcatggctcacaatctctttgactctgatagcagctccagagttttgacgcatgagatttagtagctcctcggaaagagacaacattgtaccaaccatagggcaagtaaccatgagtctcttagtcacgacattgtcgtcgatagaaagaggagggctgggtggacagacaagaatgcattcttccttctgagacttaacaggtgtgtctagcagtagaggggacggaggaggcgattcgaatctctttgatgcgagtttgtactcggtttcaggaggaggggagcaaggaagagtttcaatcgactcttggggtaaatcttccactttagtgcatgcagaagacacagcttcacgcgacccactaacaaccataggctgattggggctagaaccggcaatgacctccatagtgtgcttgtgtttagtttcagccgttttctttttacgactaacaaaatgtgcaggggaatcagggggtatgtaagtgcctgtgatgcgtcttcggagaggattaatgttgtcgcgcggttcgtaaggactggactcttgttcaaaacgtttcaaaagaccagtgtactcttggaagatgagagatgtgaagtagacggctcgatgaagagaatcagcgacacctgtcgcagtaaataatcggtctgttgagtcagggagtccgtctttgatggcctctatagctgctccgctcttgcgatgcaattttcgcagtccataacccttgaaacccactattttggcgaccatgggctccgggataatcatttgaatagtaaattgtgctgaagagtcgtcattgttgcctgtccaagtcctcacaagtgaacctatggtgcttccaatgttctctggggtgcctgtgatggacatgacacggtcggtatgtgtgttgatgaaaggagaaaacttgattttgatgcagagagactttgagagctctcgaagagactgttgtttcttgatcaagagcttctccgcctgctcagaggctacaatgaacctcatgtgagcttcatcttcattgagctggttgtgagatctcttgaccattttgaaaggcgaagtgggctttttattggcataaccgggcagataagggtctctatttattgcaaccgaacacgggtaggatgcctacacttttctagcctttacatcgtccagtacattaccggttcaagggtatacatgaagccgtctctacttttatgagaacatgctacttgtagcatgcaagctcatgtgtcttgcgcaactctattagcctgctctccttgtattcagtcctcagagtgggcttgcaacgcccggattttttcaaaaggtgctaaagatgacccatgcagcagtgatagaggcagaacaagcacacactaattgaaaagcaagtggtataaggacgaaattagactaagctagccgcccaaaagcagctagttttgctcgcatgttctacactggcggttcagccacggatttaaggtaacctgacagctgtcgcacccgagcgttatgttgtacatgacactactgtagacaatcgccgacgtcatgtacgagttgaaaaaatcaaacaaaaaacatcaccacgacgtccgagagatgtccgaaaaagttgccgaaagaattccacagtctatgcttttccagtgctcctaaatctgaaataaaacccagcgctggtcagggaggagaattagtagctcttaatttaatggagaatcctgttgataacagtgctaaaacaaccccacagcttttgcaaccatatcataggaggtgtttttatggcggtctgtggactttagagatctaccacggtcttaaaagggtggggtggaagttgagaacgcgtcgaaattcggtgtacgtcttcctgcttgtggtatccagcatgaaagctttcgtagactagttgtaatacacccaaggccgagtcttccgaggtccctgtacatacaacagaaaaatgcgcttatatggtaatacggatactatcaatataagaggaagtctatgatattaccccattcgggtgggcaaaatggacaaataagcagggttctaagatcatgaactcgtatgcttcccccctaataatacaggcacctgagattctggtcgtcccgcgcaacccaatctcgaagacgctctgtgatatggtagattttgcggaacagaatctcccgctcctccaagctattgttagaaacggcaacccaacaagccatggcctttagttcctgctcacagatctaaacctacacaagcttctcataatctgctgaaagcagaacacaatgggctggaacaagcgtgagaccccagtccggaacccggttcatggcctcttatttactttatctcacttcttttcgcttgttcttcaatattatggtaatagagacttcattgtgtgattccagcataagacagaagctcgtattggcaaccaaattgagctcgggatggtctttccccacagagcccagttgccgaggtgcttgtgccacacattagctgccattagatggctctattgcaaacacaagcctcgggtttttaacgtcacatgggaatttgttctctgctttagatctgcttagtagcgccataggtgcacatggctgctttttggcaccaactagtgcgttggacaagaaagatgcggattgtcctgtactacgatagctcggaaataacggcaaaatagacagcagcccatatttcccccatcggtttcgggaccagattatcaaaaaaaagtaatcgttagtcccaggcagcatgcttgcgatcgggtcttgcgatcgggtcttgtgcagccagacacggacgagtgtggcgactacacgagagctctgctaccggtagttattcgaagtgtcacgaacaagacgaataattctttctattgcttcaatacgacgtacagcgctgtgccacaacacggggtaatgtcctcatagctctcaattatggagatggcaaaagcccgtggatattcaagggcttccgcggtgctgtagtaaggtccgaaaatggtatcaaatacgaacgagcttccaaatgaaatttcaaaaagtatcggataagcggctattattctcctgagtggctacaagtagtagggatatcttttgcaatccatggtttctggactcagggggcatgagacacgctacgagtttgcatctgcaagggtagtaccagtgacttacgctggatgccgatccgacgcgcttaacatattgtattatgcgactgcaactatttctgtgtttttccggctgtcattctaataataggtggcccatgtcaccttgccaatactgtacatactctaccttgacaaaacagtttgtgagagagagagagagggagagagagagaaagagaaagagaaagagaaaaggaaaaaacacattgagacgtcgagatattgacagttcattgaatcatttagtttctgaatattctatgtgaaaaatggtaaatgctttgatgccagtcctctcaatcgcctggctcaaatttcaacgatccaatattgttctaacgaggagtttcccatcgggcgatttttgtgtacacacaacacaagatatctggacagaatgaatgggtttaagtcacgtcagcactacaagtagtggatcattatcctcacgtgatagagtaataagtccggtgttatgcatccacggacttatgacttacaagatagagatggagtttgtaacaaactagtctcggtgaacggcagtcgacattattccgaacactcacatgagctaattcccctccaattaccacaattttctctgctactgaatgaatccattggtccatcaccaaaagtgtacgtcagagagctcggaggacatgcagcttaatacgaaagcatatttcggaaccacgtgttgagagatgcaactactcaatagatgagaaggggttcggactggctgtaaatgatccgaatgtacgcaatacgtagtgtaccccctgactgtcggaagtctcggtggatacactcttagaagaatgcggagctgtatgcatacaacattctatgtatgagtaacataatacgacgtcaggaaccaaaagaaggatatacttaccttagatagagaactaaaggtcactaaaacagctatactacaatggattcgatacaccttatcgttcccttgtaaataacacccgtcttgtctctgaggaggcttgatcagagtaactgacctaagaggtacatctgcatgaagacatatatcgtcatgttacccatgtctacacctactatacttagagctatgctataaaagtacgacaaagcaatgccatatggaagcctctattgcgttctcgctattacggaagcaggaaaagaatacggatgaagagcgcccatacacacgacacaaccctgaaatctccgactgtggcttgctattgcatctattgtaaatactcttactaagctacttgtagagtagtaaagttgtattgacacaagaagaaattgatatctgggttgggattctacctacaggtactctacatactgagctactgatctgacaaatgtatgtagcaccatctcgttgaatgttcttcaatcacttccaggggttgttaacgactaactgagttgattaatgtaacctaagaggtattctccattccactactcatgttggacacagttggtagctaataaacatgtcccccaattgtacttagtcatcaacttactgttcaccgactcctatttggccacttactaggttcatcgtcacagagctttgaccagcccacaaatgtgtctttctagcatcccatcaatatacaacaagatactacttgtatcttactggtatagacacaaatgtctgaacatacctgtccagccaccaatttagttaagatttgcgatttgaaaatgtgatcacatgactgcatgttgcaagcatgaactttgggaacaacggaatattgtgatctcttcctctctatctacacgcacaaaatgaccaacgaggatcttctttcggactcggaaaacgatgaggactttgcctacaagtcggacaaggaggaggacttctcagactccgacgatgaatcccgaaaactgcagcgacggattgatgcggaaaacaagcaggccatggcgaaagaagaggtcaaggtcgacaaggacgccatgagaaagatctacgaggagatgaagagcggatctggcgctgccaacgagataaagccggttacggtaaaaaaacctgacgtcacaactacgcagactacacaacaggagactgcttccaccacccccacagcatccaccacatccaccaccacatccaccacatctgcaccggcaccagcatctatcccgtcttcagcagccacaaacaaggtcaagaaaccaaagcgaccgaagaagggctcgttgctggacgccatgaacaagcccaaaaagaagctcaacaccctggagcagtcaaaggctgactggggcgcgtttgtggacaaggaaggcattggacatgatttgagccagcacaacaaggatggatatctagaaaagcgcgactttctggatactcactgattgcatattcacaccatcggcatgtacataaattatagtgtaaaacacacaccattatgagaggagttgtagtgcggaagtagacctgacaggtacaggtagtacaagtagctactgcacattatattcgtataatcagagagtgcacttaagtgtagaagtacagtataatctgcgactgcatatactgtagtcaatatctttattatgtacagcgatacactcaaagtggtcgcaccagtagaaacgacacgtcttgtcatgagcacagactgactgaaacccagactcatcccatcgtacatgcaaatctattgttaaataagtcaaccgtgattgtgttcctcggtgagagcggtcagtaacatcgtgacgatactcatgataccttcacccaaaatgaggccagaagaacagacaataatgtcaatatgagcttcggggtgtcgtctctggtaaaagtaggcgatgactccacccaaaaatcgggccagagtgaatgaggggacgttatatagacccacaccgatagctacacccgatggaagcagagaaacgtggtctcgtagaatggctagagcagaaccaatcactccaaagacggcagtgaaggtgcccaccttttctggcaagcctcctcccataaccaatcgggcacagtcgacccaaatgatggctgtagggattctgaacagtgagccgggaatctcgtagaccgacatgtagagtctgtagacgagacctgacaagaacaccgagaacagcgatcctgtgatctgagcaatgaattgagacttggggtacgctccaatcagatggcccgttttgaggtcctgcatgaggtctcctgcctgctgagctccagcctcagcaatagctcctgctacaagattggacagaatagtcgaattaggaatgagcgagaggaagatctgggagatttttccgattcctgaaacggggttgagatcggtttctcctagagcacgaacaccgagcacagagagcagcagagcaatgaagacagacacaatgatttgaatgagatggatctggggaaaaacaatcttgataccaactagacaaagcacagaagataaaaggatgccgattcctgcaaacctcgagctcaggtcgtattcgggatgctcatgttcaacatcatcggcctcggtggaagtataagccgactctgtatcttggaaggcatgaaagtagtgccacacctgtttgtatgttaacaccaacagagatactacactgtcaccgaccatcagcgccagcgaaatccaaagaatccagccctgacctccggttttccagtcgtcaattggtcccggggcccatcccttgtattgtgagtaaggagctagaataccccatcctaaaatacagcccagcagcatactcgaagtggtatgcagacccataatgaagccctggccaatgtatccggggcttgggttgaatgtccagaggtagtttttagccagccaatttccaaacacgggcagattcctaagaatcggtagaaaatgctggattagagtacatgtggcactgattgcaaacgagattttgagaatcttcacctggcgtgcgtagctgggataagagcttggactgacggcgtcttcctcttggtccacatgtctgttctggtctggatcttgactctgttcctgttcctgttcctgttcctgttcctgttcctgatcttgattgtcattctctctattatcttggttctcctcctcctcctcctcctcaatgtcagcctccacaatggctttgactttctctcgctcatgcaaaacactaatcatagtggcggtagcggaccccgatgggaacttgagctgctctctaacaatgacttgtcgacgtaacagaacggcaaaaaatactccaaagagcgatagcgatagtgaccacagaatgagctggccaatgtgcatgaaaattggctcgccactgttttcctcgggcgtcagaagcttctcaatagcaggaacaatgcccaccagtccaaaggcaagaggtcctgtgcccactgccacagccacgctctgggcgtaaacattctcctcacgagtgaaggggaactccttggtgagtcccggaaacgctcggaacacggcgtatgaaatcagagctgaaggtaagctcatcatggagacccagcctgtctgaagtccaaactgaaaattgctgaaaagaatcattgatccgatggccagaccggcgatagtggccctgagcgtcacctgccgcctcaggtgcactatcgtgtcattttgcaatagcgaatattgcatgttggaggactcggtgggtcgtgagtcgtcctcggaacgtgtagagaggatgaccaattcgtgcatctgagatgtgcttggcagtgccttgcttgtatgtacggtcacgtgagagataacgttgtcatgtgacgtggtcggtggggatggtgaggagtaaaaaacgataacgccagtgctggtgtgcggggatctcgtcgtgcataaaatatgagcgtgtgcttttctacggttagttacacttgctgtcgatgtctcaagctcttggatctattggaagcagttgggggcatggcacgggtatattaaactctgtccttcatgggacgtaacattggattgtatggttgtgagacgacactacattataacctccttacttgtacagtatatactgtattttatagtagatgaagcgaataattatatcgactacaaatagcaatcatggtgtggcttagagtgtagctttcattttacttcattaacctgacgaagtaatcttaatataattggatggtagcacttcagggtaaccccgatccaaaattgtcgccatgtcatgtgaccctggatgtatcgcacgtgtaggtgtatggatgatccatgcaactaatgacgctacaagtacagtaataagtgtaacaaatttaaccaccaaagggctggagttcctcagctgttttgggggataagcacatgccatgctgattctaagcacgtgtgtatatttattcactctgatttactttttcaaaccagcactgtacgggaagatcagcttgtcaaggctggcaatgatctccatttaaaaagtaataagctgaagatccaccaaaagcaacgaccgagagacaaggagtgaaaaatataatcggactaaaccaaggaacagagcgagctgatggttgtttctttttgagactaaggtagagggagccaggcaccaaaaaagagtaatagatatagaggttgactacacgtgggttgtagggatcgtaggggatcgcaggggaatctttcagtccgcggagttgagagaagtggttggtggttgaaacccagtcgtctgtatacttcttgtttgacctgcgatatcgacgtgctcatggttatgatgtcggtcaaatagaacgattaagctgctgtttgcacgatagagaacgttgtcattagagcgtgggccgataagaccattgattggtagaatcaatggttgtggtagttgcgtgtaccagtaccctgtccagatatcaaaaacgggaggcaagtggcgaagaaagacgtgcactatagaacaacgcgtatgttgagacatgacgagcagtctacaccacccctattacccctacgcatcctgaatcaggggtatcttttcaccaccgttaccggagacttccactgataaagcccatcaatgtcgatcaccagtagcattgaaattaggaataacaaagcccaggtgggtagagtatgagtaccactcatcgaagccaccgggatcagccgacgaagctgagccgcggagtttgtccggtggagatcttgacacctcaaacatggaattatatcataatactcccatcatatcgcattggtgtgtccacatgtacatatcaattacaagtacagtaggggaagcaaataaccagacactctcctatcaccaaaacccccattagactataggggttggaatgtattgtggtccgcaggtgccagaccaacgacgtataccccaactcacagaagtgacggagaaccaagtacagtagcaccgactgctcattccatcgtcgaattccagacgtcagatgtcgtttcctcgcgacgttgcagtgcgtgttgtggatatgttaatgtgtccatggcacggcacgaaagcccgctgtttctatcgccacagttggatggcttgtaccgctacagtagaaatcctgcaccactccttgctctagtcaaacacgtatgcgctctctcttcaccaccaacgggcgattagcgccattataggcccggttagcgtgttttcatgcgcatcgacggctctaactgccaactgtcattccgcccaagcccttctggcacatacccgagcttcctggcacctgtctgtcttgacagaaatactgggcctgaataccaccttcccatttgagaccatggctcacaacaaaaaagaaacacaacgtcttacgagtattggtgaggttgttggtgtttcgtgcggcttatctgatagtagattattgagacattttttgtcggcaacgcatgctgtacacccttggcgtagaattcatttcgcgtgtaggaatgtgcatagactttgtcgatagcaatgtaggatactggagataacaatgagacttgtagcgggtaaatctattgaaaggtatatagacgaattttagccgtagacaacgtctcctcctcgctcgtctcttgaaattcacattcgttttgtgggagcggccatgcacagatcgactacagtgatctccactatcttctctctatcatgcgcaactcactggctcggctctctgtggtgcaactttgatttgagcaggagtgtggagataggatctcttgtggctgaatattactggactaaaaaatgcaggaaacgagtgggcctcataagcatgctgcgagtagacgggagcccggcgcgtatgtaggggcaacgtggaatggtctccagtagagtgcgttaagttcactattttttctgtctctggtctctattttgcgttccctaaaactctgaagtctgcacaagagccaactctgcccaaaactcagtaggcctaagcgctgtacagtgctttttacttgagtgggatcttcagttacgaacgctgatcttccaccacccggaagatcagagtgggggggagggggggaggaagcgacaacaagacgatgaaggatcatggagaaactaattacttgtaagttcaagaattttctctccgttattgtctacgattagccttatccttctcttaatatcgtgtatatatgtattgtatagtaaaagtcgttttgttttatcgtagggcacaaaatggccccaaaacaagtacgtacatcctcgtgtatgtatgtacacttggatactattgtattaacggtggattaggtcaggaatgctaatggttacggcactcgtactgtgccaaatttaatttgttccgtgtctcagacgatacgtttgacgacgcaaaaaaagttggttttatacctggttgttattccgtctctatttttcgtctttctggaaatttatggttaggctcacccacacacgttgtacgtttccaggccaacacattgacctcgtgtaaacaaagaagtcattgtggtgacgtcaggcctggacttctcgcaccacacccatgagtccaggagttggtcatagttacaaacgtgagccacagataatagagctcatagctaattgctggattgataaatatcgaggttacacacaggtcgagacatcctcaaccgcactccattggctgtccagtatcgcccttaaagcgtccatgttgtcactcgctcttgtatcgtttgtactgtcaacgccgctctcacatacatacaccgctctcatttcattgacttgctgaactcagttcctgaaaaagcccttcagaggcggcatacaaagagagttccaagtgaccgggcaaggtaacggtgaagaggatcattagatcaataagacccccctccctccaactcgggttctggccagccccccctgatccccaggctcagtgtaacatcatcgtttatctcgtccaccctcccactgccgtagccatgttgttcactgtcgatcacttaaccaaaagctgctcaagatttcacagtagagttgacacacagctctagcttgaaccttaactaaataaagctaagtacgaaccatgtttctgtaaatagtgcgtccgcggtatatatctacctcgcggggcgctcttttttcaaaggcaccagagtgttacccaaagcaattttcacccctcaaaaaaccctctcgacagttccactctagcgcccatccctcgtttcggccttggcatatcaccctctaacctcgttatccaccaacccatcccaaggcatcttcctgacataaaagtgggcaactaacagactaacctcgacctcttctctgacaacttttctatcacacaatgggctacacgactcccgactcgcatattattggagaccacagctttctggacggtggagccacccccaagttcgacggacccatggtccgagtgtcggaaaaacaccagcaggcccaggactttgtgcagacacttaaaacccacgccggccgagccaccaacttcaacctgcatccctcgcagcccgcccgacctctgctgatccacctggctctgattctcgccatctcgctcgccgtctacctgtgtttccgagttctcaaccgaactctgcgcatgctggttcgaaagattgcgccccagagccctatcacctcggccgtgccctctccactcaaactcgacgaaaagatcaacctcagtccaaactcccaggcctccagcggaagcccccccatgcatactcccaccactccgtttgagatttccgagctcgagacaggcaactggtcgtctccctccgctcctgtgagcacctccatctccaccaacgcccacaactcccgagaagtcgactaccacaccgacctgcctggccgaacggcctctcccgcctttgtgggacactgcagcgagcgagaggtgcctcttgacggcttccgagtgactactcgatgctaactaactactcgatgctaaggtgttttgaataccgttactaattattctgagtacagtaagcgactgtgctctctcacaacccccatcccttgtcatccagaacaaggcgtgcccaatagccacccctttgcatttaattgagctataaccaatacaaactcatactttgaaagcaccgacccgtatcaccaatccgttcttgtacgaatccatatgccatgtaaatttgtttcacccggaccaacttttacgatccgtcgctttactggtgcttgcactcgtacttggttcatattatcagcttatgcaaacggccttctctgcatcatgttctgttgtgtgaggttacatgatttcagcaagtcccaaaaatatgttgaaacacctccgcccccctcctcccacatgatgtgtttgctctgcttgcgatcgcccgccttgtgcatcctcacctccgtttctattctcgtcgacttctatatttggtagcgcctttctttcttcacctcctctctcactctccctttcttgttcgctattttgggctcttctattttgaaactgtaatgacgtcaatgcgtttaggctctggagttattgaccctatggtccgaatctaatccatcagctaagttacttttcattgtcaccttcctaatcggtatatccaaacagagaagtagagtggagagagatgagaaggcgaagagacgaaatcaagacggaaaagctcagtcgttcgagatagccgacctcgcgacagctagaaccatcagctcatcatatagccgcactcatgcacttcccgcgctactggcgtcggcctacctgtcgtagcacatcccttctcgcttgtttaggaccaaatagccttcaggtcattggttgtggctgtggtgggtccagacatgatcaagcatatcagcggtatttgtcctgcgcaagggaggaaaaatacacacattggcgcaatatgaggtgagaaaaacacagaggtcctgctgcactatagttgcattttctctgtttttttcttgtttttttcttgtttcttcccttctctctctataactacagcacacagtggactaatacgggtaaagtcctgtatagaggactggtgcctaattaatctacattggagataaacgaaaccatgtttattgtgaggataacgtaaataagtccgaagaaaaaaatgccgatatcaagacttgattggtacaaacggcgtaacccttacaggttgaatcgccccaatcgctatcatatcgtcaattttcagctcttgtgttagttacgtacactcgtacttgtatcgtactcagagagacaccaactactttgagagtgcatcacctccttgccctagaaaaaaaaagctcatagctcggataaatgacagatgttgacaaaaccaggaataaggcccgtggatacatctgtcgtattgtccatgtctcacttttagtacatgctgatacaataccctgtccaactctttcttaatgccttaccttcttggataggtcagcacaaagttcgtactcgtacggtgcagtcctctcatccacgcacatcaacacaacctggggttgtagccgtccctaacatggtttcctaggcgcgcgtctggcgacaccttttgcgacccaagctcaaacctcaaagttactgcattgtcggtgttgtttgctgtttttaaagtctcatatgaaggctctgtcgtatcattaagtgaacgccatacggcattgtatggttggagttgtctgagatattctacacatccccacgtcacgtggaagcacttctttgtgacgatacagagacagcagaaacccgcccatgcacctgcagtctggtgctcatattggcttggctcccggtcttccgaaggcacagacgttttgctcctattaaccaaagatatcatggcggcccaaagtcggaggtgtttggtagacgagactttaagcacgcaaatccaagtgtatctcctcatctctgaacgctgacgccctatatggaacctacttcgagaagcggtcatctctttagtgtcgaaaagtggccaaaacgggatgtctggcaggtgcggctgaacggctgagtgacttttgactattcctaaactatcgtccatgcaccctctggcaggtaaacatagcgccgcatgcgcaccctacagaaatcatagcatttgttgcaatgtctgaccacagacgattaagccataaacagactacattgtagcaataatatacctactattggtcattttaagccgattcatactttaacagtctaaaacaacaggtatcaatcactgataggcatatagcaatctaacataatcactcagagcaatttaaagatcagctgagagctgtgattgctgtgatacattgagacgttgtcagataccatgctaaagatacacattctgatttatacaacctggatcaaaatagaaccatattgcttcttaacgactccacagttcattctaattacagcaaccgcctgcgtccaatgtgttacccggagacagtttcacacactaaaaacagcgggtaggtagagtagactcgtaaaggaaatcgcaaaaatgaaaagacgaggatacgcgtggaaccttggactatagatgtcagattggttcgtgaggtgacgttcatgaataattatgtactgtaactcttgcgttgaccctgccttggggggggggggggggggggggggggttaaccccccccccccccccgaaaaaaaaacccaaaaaacccttttcccccctttttaaaaccacttcccccctttttaaaaacaaaaaaaaaaaaataacttaaaaaaaatttcccgggttttaaaaaaaaaaaaaaaacccaaaattaaaaaaaaaattttttttttaaaatttaaaaaaatttaaacccttttttaaaaattccggtttcctttaaattaaaaaaaattaaaaaattttgcacttcccccccttttaaaaaaaaataaaaaataaaaccttccaaccccttccccggtttttttcccccctttttaaaaaccccaacttttttcttttttttttcccccccccccccttaaaccccgggtccccccttttaataacccctttttttttttccctttttttttttccctgcaaaattttttcccccccccttaccccccccacccccataccccccccccttttttttaaaattttttggccccccccctttttcccccatttttttttttctttcccccctttccccaaaaaaattttccccaacccacaaaaaaaccttccccaaattaaacaaaaaaaaaaaacccaatttttttttcccaggggcccctttttttttttttttttaaactgttaaaccattggttttaaaaacctttccctttttttttaccctcccaaaaacatttttttttacccccttttttttttaaaaaaaaattgggaaaaaaaatatgggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcttaaaacggaatttttaggaataaaagattgtagacgaattaggttatattatttggtggtggtttttatatcatttccaacatccccccctctactggaaagctttttttttataaaaaaaaaagcaaacaaaaatcatccccgtccactctttgttgtttttttattttgtttttttctccttttttacaaaaataaagaattttttttttattttacaaaaaataatataggcgcccaaaaatttgaggtttttgttagacaaattttttaaccccaaaatccaagtgtttcttcctcctttctctagacgcggaccccctatattaaaccctttttcggagaaacggcttcatttttttatgtgtgtgtgaaaaaaaggcccaaaaccggaatttttttgcaaagatggggttaaacggctaagtaatttttttaatttttccataaatatggcccagccccccttttggaaggtaaaaaaaggcgcgcgcttgcccccccctaacagaaaaaaaaagctttttttacaatttttcccccccacccatttaagccataaacagcctcccttttggcaaaaatatccctccttttggtcattttaagccgatttcttttttaacagtttaaaacaaccgggtttcaatccttgatagggcatttaccattttaacatattcccccagggcaatttaaagttcagctgaaagctgtgttttttttgatacattgagacgtttttagataccatgctaaaaaaaaccattttattttatccaccctggatcaaaaaaaaaccatttttttttttaaaaactccccatttttttttaattacagcacccccctgcttccaattttttacccggagacattttccccccctaaaaacagcgggtgggtggagtagactcttaaagaaaatcccaaaaaaaaaaaaacggggatacggggggacccttggactaaaaatgtcaaattggttgggggggggacgttcaaaaaaaattatgtactgtaacttttgcgttgccccccccttgggggggggggggggggggggggggggttagtcctccagcctgcccggataagtaaacgacagaaagcattttcgctacttgtagtacacagtgtacccgtgtttatgacactacatacagacatacagtcaagcagagtctacggtggttatattcacagaaaatgcgcgagtatggaccagtaggtgtcggtttacgattgttaacaggttacagcctgttgtcacaatctcggtgactcttaagtcataaataggtacaaaatgtggcaatctcgagcctggtaatgaaaatatagaagtgaagacttcaatagctgtacctgggttgttgatcgctagttacaagagccgaagctgttcactaattggttcctacaccggccgttgaactgcggtgtcctacttttgatagaccagtttgattattccagtcttcatgttcctggcaatactattgacgccgacgtacaacccacagacacagtacagacgcgacattgtagtagactatatggggcacacggtcatttgcgcgatattggttatctgttgaccctttcgccactactaatgttcccctagacctcaagcaaaacctgctcacgagtgcacgcatacctataaaccgcagctgctgtatagccaaggcggacgcttgtagctcgtgatgttgtaaccagggttacagtcgatggtggtgtaaggaccatcttcactgtattctgaacctctaccagaaacgactaggtatgtatcgtagcggtttacttatgtacgatactcacagtgtggggatactcacagtatgggggtactcacaatatggggatactcactgtatggggatgctcactgtgtgccttgtgggtgccagaatacaatagagccaccggcccaaccagtaaagctacagcgtagaaagattataaagagaaggtgaaaggagagagtacaaacttgtgtgtcccactcgtccccttctcccatatatcctccgacccggttctagaatattctgttatcatagctctctctggcgcgtaagcgttagaacaacacaatgcaggggtgtatgaacaagcagatttacacagtacagtatatacctcattgtgcaaaatatttgagaaccccattacagtagagcctaagaaggatactttcaccactcctcctcctcttcctcaccccgtacatcactggaaggaaagtagttattactaaaaccaataaaccccacaatatacacccctgaaggcagccgaagctagaaagcatgctgatctcgacctatgaagtctgtttctatacctttctgtgtaggtgagaactacaccatccatagcctggactggaccaccaacccgccttgtaaatgtagcacaatgttacatcttgctcattgacacgttacttgttctctaatctactgtaatcacttactttctgtacatgggttcttgtattattctgttacgtaccaaggtttcacttattagcttgggccccttactttacaagtggttgcagccagttgtctactgtggcagtcaggaacatcttgtacttcgaacactggcaacaatcgtagttgttgtctcacaaatcgacccaaggcagtgcaagtaaattaggacaatagagtactgttttatatagccaaaaaaaaacaaaaaaaaaatagtcgtttctttgcttacagtatatcattattggcagtcagaaagtagtgcgatacacgtgaacagatacacaacaccaatcgcactgacgtctccgcttgttcccaagaagcacacgacgtaagaatttggaccagttggccttaaaccattgcaaccaacgtcatcgttagccaccaaaaagcaattgcttcccgtgcacatttacagcatttaattccgctgaaacacggcaagcggcaaggaggccatcgtgcagagccaggcacatgtctacaataccctccatcgcccagtgcttgggttctttaagcctgcttgtgccaacctgtgcttttcgcaaatgctagagttttgctttcttttaacctgggcgggggagacgggtggactatcagtgatcagcgatgaggttggtagtcagctgccgaacttgtggtcctctacctacgatgcgataaaggacccctaaccaacttcgcagacacaatgaacactggtgcagcctgataccatggaagcagccctttgacagggactcttacctgcaagccgcattcatcttctagcttttcatcagactttttttttatgtaccatgggatatcgtacacacaaaccatgggcaagtctgagacagagcaggggggaaaggggaaaaggaagatatattattttcgtacagtacatacgatatttatatcgtagctatacagtgggtcttcacagttagaattttagagctacaagtaggtactcgtacctttgctattctgtaaacgtggtgtacaagtgtcacttttggtcgtccgtacttcgagacatgtgacatcttgggcccacttaatgatccgtttttggattcatttttttgtccattttttgattgtttgtggcatcttgccagttgccggtggcatgatggctctttttttttgtatgataggttgaagtaacgtacaaagaagtgcaccttttttcttgcaacaccgacccgtatttggctttgtttggggcaaacggacggcagatctgcagatggacgcagttgtaactgaacatctgtaaatctttgtgggtaggtcggagtgcagaatgtgggtgaatcagctcgtttgttcggctgattgcttacgcacataatggcggtttcgtgatctagttacataccaatgttactgtggagcgtcgtttttctcgtttgccttatatgcttgttcgcttgttttgtcttttctcgtggttgccaaaaaaatgaattggcagttctttgtctcgctcataatggggcacgtgaaccttgtttgaaagacactgtcgatcacacaacgtaggtatatgagggaacgaaagaggaatagcggggggctatcgagggcccttaggcttccaaaaagctaccccagttcctcagcgtggaattttccctcatttagtcttggtcgggctcaaaacgtcgattgtgtcacctgagctagtgcttctaaacaccaattcaaagttgcattcagctgcacgcttcatcctttttagccacccaacaaaggcaaggttaggccctagaaatagtttactatagctccacaaacgcagatcggagagaggctttgtgagatggctgtgggggctctcttatatagatgggggtgggacttgcaaagccgaagccggaatcaaaacccacacaaacgttttctcgctacttcaggctctcacagcttcaggcccaagcacagctcacgtcaccgcacattcttggtctgcacagctcgcatattgtgctgcaatcatccgtctaaaagcgttggaaaccgcttttgtacacggtgcacctccgacaatttatatatcttttccactgcatttgctgacgtttcgccttacgacttacataccgtcacaccctccactcacgccatgcctcgagtttcatcgacgatcggtctggcagttctgattgcactggtgatgctagtaggagtgtccctgcgaccacagtctctgtccccctttgacaaatatgcatacaacagctcaccttcgccatcagcagggcgcgcccaggctgtttccaaggcccaggtctttcacacatctgcatctccaccaaaagtcgtggtggctcaaacaggactccctggacctgttgctcaggccagtggcctcgcaaaggctggccaggctgcgggaaagcaagttggacctcctcctagtcccgagcagaagccgtacgactatgagggacccattgtgatcatgcccgacaacctggagaaggatatcgaggagtacaaggctcgaaagaagaaggaggaggaaaagcgacagaagaaggagaaggagcagaaggaggcagctgagaagaagaaacaggaagacgagaagaagaagaaggaggatgccgagaagaagaaaaaggaagaggagaaacgaaaggaggaagagaagaaacggaaggaggaagaaaagaaaaaaaaggaggaagaggaggctaagagccgagaggaggaacaaaagctgcgaatccaggaactggctggtgatgatagttcgtttaattcgctaaaggccaaggtggagaagtttgaaaaggaattggagcctctcaagaaggatctggaagctgccaagaagcataaggaagagaccaagaagaaggatgaggagatgcgaaaggaaaaggagaaagaggctgccaagaagcttagcaacggccttcagggagacttccacaaacttgagagagccgaaattaaggctattgtcgaaaacccgctcaattacaccgaagctgagaaaactgatggaggccacgtggctccctacggtggcaaggtcgtgattctgtctgcttccaacaacaagacaaagtctgaacagtacatgcttgaacgggctcttctcaaccgacaggagtactgtaacatgcatggatacacgtgtcggttcatcaacctggaccaggtcgatgatggcaagcatcatattgtttgggccaagatcaaggctattgagatggttttcgagactgatcctgaagttgaatgggtctggtggatggacaccgatatgattattctcaacccttatattgagcttggagagcatattctgagtgacagggcactggttgagcgacttacttacggacgacccatccgatcggcagacgcctcgttcaagggtgagatttaccattccaagggccagattgaagccaaggatatccatctacttctgacgcaggactttttcggcatcaatgctggttccttcttcctcagaaagtctcagttttctaaattcctgctcgatctatggtacgaccaacactttattgacaagaattacgtcttccgagaacagcaggctctcaaccatcttttgcggtcacataagaccgttcttcagcataccggcctgtatcctcagcgtctgttcaactcttatttgggtaacgagaaggatgtgtggaagttcaaggaagacgatttggctgttcattttgccggctgtggctcttccaggacttgtgaggacaagttctcccgatacatgaagatccgaaagcgtgtgcccaaggagttccaggttgagttccccaaggactagcctacagtacctaccaattattggtttacgtagcattgaatacatacccataaccatcctggtaactattgtacggtagccgtgcaggcagatacagacttgttatttgtaatcagacacccctggctaaagtccatattttcagccgacatggtttatagtacgcaattcagcagctaaaagtgatagcgccgcagctctatagacccacgctattttaggcctgagtttactacaagtaggaagacgacgcaacacgccaattactgtagttgtatcgcactttcttgtagtgaatgtgtctgagtaacaaattatgccatagacatgtgatggtaacaagaaggcacatttgacgtcattggtagtttccatcaccacggaattttgaacagatccagtgatactaaagcatagctagcgactggtaccggcactcgcaaaggatgcacgtctggtaccgcatgtaatccccccttattgaattaatcaaacgcttgaatcgttctgtgagaaactaacttcaatgtataccactttgtgcgcagattcatccggatccgacgatctccactcatgcacctgaagctgcaacatgctgtaaataacttcggggtggacatggagtgaagaaacctagaaatacgatacgagacatgaccttattacaagtacattatacattatacagtaagtacgaatagaagtacttacggattatacgtatccggaaatagcatcaataaacggttctccttgttgtagttgtatagtccgtcggttatttccccctgatccggcatagaccatgactactgtttgaaacaggtatacgggcggtatgacaccacgccgtaagtatcaatgtaactgagcagcaataggttaagctacaatatattccaggaggatattttggtatcaatcgaatcagcgcgaaattctgaatcgatcgatatacttttcatgatccctaaaagcatccaaacactacatcatggtgttgccatacggccaaaaatacagcaatagcaaattagagtatagtgaacaccccaacacattacaagcagatttcattcaggtcatatcacaagtcgcgctttggcgtgcattcttatatacgtgttgaactggtaggatgcttagttgaataatttaatcgtgtggtgtcacactgcggtcttagaaaagaccctcgatctcgcccttgtcgttgacctcaacgttcatgaagccacaatgagtggggagaccaggaatggtctggatctcggcagccagagcgtagaggtagccagcaccaacagaggctcgaacatctcgaatgggcacagtgaagccagtgggcactcccttgagagtagggtcgtgggaaagagagtactgggtcttggccacacagatgggcaggttgccgaagccctgcttggtgtaggcgtcaatcttctttcgggccagctcggaaagctccacgtccttggcgccgtacatcttctgggcaatggtgttgagcttctcctcagcggttgtgtcggcctcgtaaagcagcttgaaatccttgtcgatcttgttggaggcgtcaacgacggcctgggcaagatccacggctccagcgcctccttcggcccagtgcttggcgacaacagcgtcctcggcaccgtacttaagagcctcctctcggatgacatcgtgctcggcagcggtatcggagacaaactcgttgatggcaacaaccacgggcagaccgtactgtcgggcgttctcaatgtgctttccgaggttcttgcatccctctcgcaggagctccacgttctcctcggtgtactccttggggagaggagcaccggccttgacctcaggacctcctccatgagacttcagggctcgaacggtagcgacaatgacaacaacgtcaggagccagaccggaagatcggcacttgatgttgaagaatcgctcacctcccatggtgaaatcgaaaccggcctcggtgaccacaaagccggccttgtcgtcagactcgttgggttcggtaccagccagcttgagagccatcttgtcggccagcacggagttagcaccaatggaaatgttggcgaagggaccggcatgcacaaagacgggggtaccctccagagtctgcatgaggttgggcttgatggcgtccttcatgagagcagtaagagcaccaccagcaccgatatcgtcacaagtgacggggtcgccgttcttggaagaaccaatgaccatgtttccaagtcgctctcgcatgtcctcgagatcgttggcaagagccagaatggccatacactcggaggcgacggaaatgtcaaagccggtctctcgggttcggcccttctcggtaggggcctgtccaacagtgatacctcgcagatgtcgatcattgcaatcgaccactcgtcgccaggtgatggtctcaggatcaatgtcgagacgcacaaacttggcaatctcctcctcagtcagatcgtcggggttggtcttgtcgataccaagcttcttgagtcgggtctgcatgcctcgagtgaaggttcgaacgcccttcttggcaggcaccagacgcttgtaaagagcagcgtccttctgggtagactcatgaaacattcgggtgtcaatggcagcggcaagcaggttgttggcagctgaaatggcgtgaatgtcaccggtcaggtgcatgttgaactcatccatggggataacctgggcgtatcctcctccagcagctcctcccttaataccaaaggtagggcccatggagggctgtctgacgttggcaaaagccatcttaccaagatgggcaccaagagcctgcaccagaccaatggtggtggtggacttgccctctccaagaggggtgggagtgattccggtgactagaacgtactttccgttctttcggtgggccagacggtcaagaatgggcagctggaccttggccttgtaggctccgtagggctcgagctcagagggcagcacgccaatttcggcagccacctcggtgatgtgcttgggctcttgggctcgagaaatggcaaagtcggagggcacagggttctccttcttaagaggcagaggggtgatggatcgagcggtcaacttctcggcctgtcgcttggcagagagcacaacgttgtccagcagcatggccacggtcatgggacccactcctccggggacgggggtgatgtgggaggctacgttcttggcagactcaaagtcaacatctccaacaagtcgctggccagacttcttggtatcatcgggaatgtagttggttcccacgtcgatgacaacggcgccaggcttgagccactcacccttgacaaagccgggctggccaatggcggcgacaacaatgtcggcagtcttgacaatctcggggatgttggcagttttggagtgcacgacagtgacggtagcgtcagcgtttcgcagcagataggaaacgggggctccgacaatgtcggatcggccaagaacaacagcggtcttgccagcaacatcgatgccggcaaccttgagcagctccatgactcccttgggggtgcaagcgacgaaggaagggtttccacctcgcttggcgagctcgccaatgttgagaggaccgaagccatcaacgtccttgtcggcggcgacggcattggtgatggtggtctcgtcaatgtgcttgggcagagggagctggaccagaacaccgtccacggaggggtcctcgttcaggtgggtgatctcccgcagcagctcgtgctgggacacgttctcgtccagtttcttgagctcgcacttgatggcggcctcgtccgcggccttgagcttcattcgcacgtaggtggacgagtcgggtcgatcgccgacctggatgatgaccagagagggctggaatcgggggttggtctgttgcacatcggcgatttcggtgtgcagccgttctcggatgtttttggcaatggaattgccgtcgatgatggaggccattgtgtggatagttgtagaggaaagaaagatgtttagctcctgaaatcgaccttcaccaacctgacaagaataacctctaaagttaatgtggagaacgtggggtgtgacaattacaccaatgaatatggcccagcggagcagtgaggggtaacaaagactacgtagtaggcccagaattctacataaggacgttgttcgcaattacatcccatcattcaacacaccacttgactcacaacaccccacttggctggtcctgtctactctacatctctgactcacagacccgagtcgcggctttgaaaacctgaacttaatgtagggtgctccctacctcgggctggctgcaacatggggatgaggagacggcagcctacaaggtgttggggaatgggagacggtggtgtgagaaaagggagttgcgcagtcacgtgactgaaccagaattaatccggactagctctcggtagtgacacacaaacctcaaggttctctttgtacacgattcttaacttgacaactttttccaagcacacctctgttctggggcactgagccagactcagtgatttctgcacgcacttcaactggcgactaattactcgtacagtaacagaagactgcatccggcggctaacccgatggcaagaatgcattttcgtgcgtctcaagtgtattacagtgtctgtatcgtactcgcacaaacggcaccaacgatagataattacatcacttgtcaggttggatgatatggttcatgtcttagggacacattgcagtaacccattctgtaactcaaatggaaaaaatttggaatccaaatttcagtcataacctgtggctagatgtgtacaagtaagcactgttaaaatgatacaagtaccttgtacaagtacttgtacttcattttgctgtaaatttcacaatctcatctcatggtttcggccacttgtcaagtacagtatgtatgtactgtatcaacatcatatcgcatatcatcactctatatctacaacataataacgccaactccctttccgtcgagctgctcaagctgcttctgcttgtcgagaccgccatggacaggctgggctcggtagttgaacagatagtagttgaggtagccatcaccgcagccaaacttgagatcgtccagatggctagggttgtccagcagagtcagctcgttgtaaacctcgaagcccaggttgttggctagaatcacagcagatccaatcagctccttgactcgatcctgtcgggccttggcagaagaaagagaagaggtggcatagtagaagccataagcagctcgcaggttggactcggtagcccattccttgagaacagtgtggtccagcttgtagaaggaaaagaagtcaatcacctttccgtcctcctcgaccacgtatgagtagacaatcttgtcgtcattcttgtcctcggaaatggggtccacaaaccagtgggctacttcctcctcggaaaagtgctggctcatctcagaggcagcgctcaggtagttttgcagaatggcatgcacagccttgacgtcggccttggtcatggctcgcaccttgagaggcacctccttgggcagagtgtatctggcgaccattgaagcagccgtctggttaggggggatagctgagaaaccaatctcgtacagcttggtccagttgagaggtcggtggtagtatctgcaggtggatacgggagagggaagaacaacaccggcagtgtaaagagcctgccagatgtccttctggttgactcgtcgggtgatctccttgatgagcacgggagccagacgcttggatcgcagcttcttgtgcacacacaggaagttgatctccacggccttgatcagatcgttgtctcgcagctgaatggacgtggggatagcactgatgaaagcaaccatctttccggtggcagccactcgaacacaagggtaccaggtcttctgccatccagggggcttgagagcccagtccaaaaaggaggcagagtacttgaaccggaaagtggcatcgtcatcttcgacgtagttgtcgtacagcagatcgtagacctcctgaatgtgctcggggttctcaatatcgacatcggaccactcgtactctgcaggcaagttgtaaggagtaggtctcacgtcctccagcttcttgtgctcgataggaccctcactgtcaatgtcctcgtcgaacttgggcacgggctgggtcttccagaacagatactcctcccactttttggccttttctcggtcgggaatgtcttgcatggccatctgctgctggaacattttgaggatttcgttgaacttatcggcgctcattccgggaggaatgccggttccctgggcaatgggttctccgagatcttcttcgttgaactcctcctcttccttgcgcttagattcctcgggcttggtgtttttctcggccattgtgtgcagttgatctgaagctctgatttcgtgagtcctgatttacactctaattattcagggtgtgctggtaattgggacttcgcctgatacagccatccctagccctgacagtgtgttcaggtgggccggggggagatggtacttgtacgggtactgtaccgacaaaagtaccaaaagtgtatcacatatttctgggctgattatgtcatcatatggtattctctcgagtctaggtcgcacgatgagacaaacaatggatctacagtatactgtagtatatactgcatcggcttgattaaggcatcacctaaaggtacagttctactcatatcatgttgatgtatgtcattctttgtgtcgttacctataaacacttgtccattgtccgtacttgtacttgtggaagtacccttccttgtactggagctgcttggggtggctacaagtactgtacggtacaagtgccggtacagtactacttgtagtacctcctgtgtacttgtagctggccacagttgggactatactgccttgcagaatcagatgtgagaagcaagattgcggtaggtagtgtggcgaaaagggtgtgtggggaaataaaagtggcacaaagagaggcatctccctggcggcaaatgaaaatacgttcttttagtcactatttcttttcaaatttcttgaaaaatccttccacgccttcgacgtccatcctagcttctctggtagcctgccctccttgtacaggctcatgcacaacccaaaaatattttaatatggttcatagacgacataatttttttcaagcatagcgatagagctttttacaacagcactacacacacaacacgataatgatctcagctacaaaatgggtgccccgagggtacgcgacggaattccccgttaaatacaccatggacgatgaagagctcgagcgtctgtccgaactggccaagctcaagatcgaggaagcaaagaacgagatggaggacattgaggatgccaccgaggaggacgtggaggctctcgaggagaaggccaagctggacgaggagattgacaacgatcccgacctcaaggagtttggtttcgacacatatgacgatgagcccgactcgaaattgggtcttgagggtgacggtatggacaccgatgatgatgaggatgaggatgaggatgagaacaacgaggacgaggagggtggagagctcaatctcggctctaagcataaggtcgagggcaaggacggcgaagacccatacatttcgctgcccactcagcaggacttggatgaggagcgagaggagcttcagattctgcccacagacaacctgatcctggccaccaagactgaggatgagatttcgcatctggaggtgtatgtttacgatcccgaggaggccaatctttatgttcaccacgacattatgctgccttctttccctctgtgcgtggagtgggtcaactacaacccccgagaacagggacccggcaattttgctgccattggaactttcgagcctgaaatcgaaatctggaacctcgatgttgtcgacggagtctaccccgaggtgatccttggagagcgagacgagaaggacaagaagaagaagggaaagaagactaacaagatcaacgctgagcgacacaccgacgccgtcctgtctttgtcttccaacccccaccacgtcaacctgctgtgttctggatccgccgacaccactgtgaagctgtgggacctatccaacggcaaggctgcctcttctttcactttccactccgacaaggtctctgctgtccagtggaaccccgtcgaaggcaccgttcttctgtctggaggctacgacaagaaggcaattgtttccgatctgcgatccgaggacaaaaaggtgtggaaggtcgactccgatgtcgagtccatgaactggaagccctgtggaacccagttcctggtcggtaccgactccggaatgctctacaactttgacgtgcgaaatgagtccaagcctctgtggactctgcaggctcacgactctcccctgtctgcttttgactacaacaagtacattgatggagctattgtcacctcctctgcttctacccgagaggtcaagatctggcgagaaaccaacaaggacgacaagtactctctttccatggtggccaaccgagacctctcttgcggtaaggtcttctctgtgggtttcaaccccgaccaggcctgcgccggtactctttgtgccggtggccatggaggtgagctcaaggtgtgggacatgttcggaaccaaggccgttcgagaagcattcgacatcaagagcagtaaccactctaacgacgttattggtcaggcttttgatgacgaggaggaggatgagtaagcaaggggtcttcggatgattagattacaaaattgaaatagatattattagtttacgatgacccacgtgtatgagactatcgtacttgtagcttacagagtggataggaaagatatcgtatccatctatttgtaactgatacgcgtacatatagttcaacgtctcaacatttgagtcaacagatttatctatgagtagcgtgttagtctcgctaacgtatagttcgtacccgaatagtacgcgactacaacaggtaaggtgatgggctctaaaagttggcagatccatcttgtacaaagtacacacattcataatctatcaaatgtttttgttatgtatgtttgtatgtccctccaatatactaataagttatgcatgactaaaagcgttccttcattcgagaagcaacaatacgcaggtttccgtacacctttccaggaggactacccagaatgagagaaacaatagcctcccgtgcgattttgatgttggtgaagccgccgagaatgtggatcttggagtcggccagcactactcgggttctcgatgcgttctcaatggcaaacttggtcttaccgtccttaccggcgattcggccaatggctcgtcccagatggtctccctgaagagtcttgacgtccttgatctcgaatgtctcgacgtacagctcatccagtcgaatgatagccatagcatcgtccacgtcaaaacccagagtgaatgctcgcacgaaatcggttcccttctgcagagccgagttgtcgacggtatttgagcatgttcgcagctcaagctgcttctttcgggggttcattcgtacctgcagcttgagctgctcaaccagaggagggtagatcttcatccactcgttcttgagaggagccattcgatgaggaggaataggcaccttcattcggccaggcttgacgccctcgccggcgttgacggcagatgcaaatcggggctttccgtcctggtcgagagtcatctcggcgtcgtcatccttctcctggagcacggcaatgtcttctcgaggtccgtccatggagatcatgacctcgtcctcctcagcaccctcagtttgggggatggcgacgggagcgtctgtggtgggctcggtggcctgtgtctgtctctttgccgttggggcacccatgtttttatcagtttttgtggttgtaacggatcgttaacagagtgagaaatcaggctgcatgagaaacggattttttccaaattaaatttttggccagtgactgcaactctaattaatggctgggcacgatgcaagcgctatgtgaagggcttacgggaaccaagatagctcatagcgtgtccaactggtaataatggttgggaagagacaattaattggcgtgaatgggagtagtcgatgagagcaaataaatttattagcaagcatagacatctgacccacttatatacggttgcccactgactcacttctatacgggttgcagatatttcgtacagtagctagattgaaagagatgtctcactacggatccagacccccaactaattgctcatcaataaccccaattaatacttacccaatattgcacccaacgccacaaaatatagtttgccaattacgcttgcgtgccagcctcagcatgccagtttcttggtgtaaaaatcttataagctttaagccaatatgcaggcgcagagggaacatgagcaacgaaggaaagacattacactcgggctctcttctcattgcactgtacttccccacagaaacgacaacgtctcaaaattcaagttgacctatttgctaggactgaccgccccattcaactaccgtcgtctacacaaatacaacagtcccagctagttcaacactatgctcaataatggcaacactacacagagtttccagactctgtactagacggcttgccttgccctctcaacggagtagttggttgaaacttacgaccctgtcccctcgaccctttcttacacaccctaccactctccctgtgacaccgtggtattctctgcggcattcgtttcactctacaagtggcgtgagggctgaactggaggaaacgtcacgaaacgtgcgcaagtccagtgagaacctgcacaatgctgcaaaggagctgggcagcaagagcgagggcgaaaagaccgtcacagatacagactcagtcacagacacaaagccagaagacaagccaagatggaagagacccaccaaggaggaaatgctgtcgactgccacgggcttctacaatcgaatgcgagtgcggttcaagtgggcgctcttccgccaggaccgacccaccaacatggacgacatttctgcatttctttcgtggttcatggtcggtaacattgtgtggatcgtgctgggtaccaccaccttcttctcgttggtgctcttcaccatgaacaccgtgttcgcacaggaatggatcgcatccaagatcggaaacattgtctcacgacagaccggcatgtctgtcgtctttgaggaggcaattgtgccccattggaagggtggcgtcatccagtttcgcaacgttttcgtgtcccgaaggcctggaggcggacacaaggcccgaaagggtagccaaggggaggctgctgccctagctggtgagaagcagtatggcagcttgtcatcggctccgccggacgatgacggcaactacacacaatttgacctgaccatcgagacagtggatgtgaccctgtcgttttcgaaatacatgtcaggaaagggtatcctcaaggaggttgaggttaagggaattcgaggagtggttgatcggaaccatctacgatggaaacgcaaccaggaccctcgaaacaatcgaaacgtacataagaccggcgattttgagattgaaaacttcaagctcgaagacgcgctggtgtctctgcatcagccgggcagagacaagcccttcaacgtatctgtgttcaacatggagttgccccagctccgaaagcactggttgttctacgatctactatctgccaacaacctgagtggatcgtatgacaactccctgttcaccatccaccctcggcagattcacggagtgccttcttcgcaactcaacgaagacaaaacctggaagaaggtatctcgtctgagagttgataaggtgaacattgagcacctcaaccgaggagttcagggcgcgttcggctggattgtgtcaggaaacgtggaccttctggccgacctcatgcttccttcagatactgacgactacacgatgtctgaaatgatgaaggacgtactagagagatgggagcatactctgatgcgtcgaggccgaaaatcaggtgaccccatttccatgccaggtggaagccactcggatgagcctctaacaacctctgcacaggccgcgcaggctcagaaatacctggtcctggacttgcgtgtccagctcaacgatgtgcgggcagcagttccgctgttcaacactgacctcaactacgtcaacaacgccatgatccgacccattgtggcgtacataaactctcgagacacatatatccccattaactgccgtgtggtcaagaaggttgacgactttgctggctcgtggaccatgtacgactccggtctcatggacaacatttcggaggaggtttaccaagcatttgccgaaaatgtgagcaacgatgaggcgagacatcgacgaatgaagaaagtcagtctgtggtctctgcagcttgccgcgcagcttctgctgcttagtataggtacaattgcctaaatgtatatagtaatgaagtgatgatttgactaaatacgattgtagtgattgtatacaagaagatgtttttgatgtggttccaatccttttttcggtgaatgataaatatgctgttaatgtacataaagtagtatacaatggagatttaacgacgacgagcccggtccctgtctcgatctcgacgattattgtcacgatctctatctcttctatctcttctatcacgatctcggcggtccctctcgtcccggtcccggcgatccctgtctctttcacctcctctatctcgtcttcttctgtcattgtccgtttggctgcttctatcatcctctcctcgacgacctctcctatctctatctcctctgtcccgatctctatcatcgtctcgtctatctcgatcacgtcttgaggatcttttaggactcctttctcgatcacggtcgcgatcacgagagctatggggtcttcttgagtcccgatctcttcgggagtcatagcttccttctctttcctgatcaatagctccatctctctcactctccctctccttctccacctgcttctcgtcgacaatctcgccggtacgcacgtttcgcattacgacaggcgtgtactctggtttgggacgggaagccttgccccaggtccctaattcctcaggtaaatgctcctccagcgttttagcaccgagtcccaacaacgcaggccgcttatcgggcaccttagcggcctgtgtaacgaccctctggggcaacgcactttccatacctcgaaacaaggcagctccaaagtcctccacgggcatcgaagcgtagtcttctaccgacgccatatctggaagtgcattgatatcctgccgcagtgcctgcagttcccgttgttcctgaatcttaccacctcgagaagcaaatacagaaagcccgtactgaggcttccactcctctacctcttcgttttttggtgggttctcttcctcttgagccagatcagcttctcgcctctcgaccagatcctgtcgccagttcttctcctccagataaatgatcttcttggtcttggccttctcttctcggagacgggtctcctcttctagcttgagtcgttctttttcgggaagctctccggcaacaaattcggacacttgcttgacatttgaggtttccttctcgatctcgaaaagcgatccatgcgattcctccggccgctgttccttcttgggtcttgtatccgctttgctacccttgagattgaacgagatcatggggaatagtatcttgtgttgtaccgtatgtgttgagacggtataagactttcgggaagtgtaaatacttagtgcagtcttgtgcagctgatatgtgcaccacgagtacatacagtattctgctggtaatggcagtgacgtatgactactgtgctgtattgtaatcgtaggtgttactcgttcagctgaacgatatgatatttgatcgcgtgtttttcagtcatcttttatcgaagagtgatcggtgtctatacgcaattacacaacctccattggtgtttaacaagatctcccagcagctcaactgtctgcaaagtgattacttgaacgtacaggtaaagtgtagcacaaacaatgccctattgggacatagagtcaactgtagtatatatacaacaccgttctcacgtttgatccattttttcccccttgacacttatctcagcgtaatagtatcgtacagggaccagtatcaaaattcttatcccccaaccactaatctactcccaaccttatcgccatgcagacgagcagaataaaattaaagggcgtattgggcctctagattttgggaaaaaagaaatcaccgtgttttggacgtgagtaagtggagttctacgtcataacacgatgctgacaagacgcatgcagtgtctgcggggcgccggtgtctttagaaccgttgccgccctcccactactggcacaacgacccaacttctacaggcccttgacgtgttctgctctgaggaggaacaatgatcacagctaccgccacgagagtcgtaaagacaaggagatgcaggatctcaaggagtcgagaaagatgcgcgagcaggaggccttggacgacgccgcgtttcgaaacacgtttgaattcgctgtggaaaagacgcgagattcagatggcaagtcaccggaacccgaagttgagattgatgtagacagagaggcccagactccctgggatcctgtgggctcgcagtcacgacatgaaacacgccaggaacaccgcgaacgatttgacgatatcaaaaagacgctgccttcttctgtccatgaaagccaaccccagatgtacaaatggtttggagagaagatggatcagatccaggctggagcactcacggctggccagacgctcaatgaggtcaccggatacaaggcgattgagaagttgaagctgtcaattgagaagctcgaggacgaggtgttggaggcacgagccgaggttagagaagcaaagagaatgtactcggatgccatctcggagcggtccaacagtcaacgggaggtcaatgagcttcttcagagaaagcacaactggactcctgctgatctggagcgatttacagagctgtatcgtaacgaccatgcgaatgaacattcggttaatgatgccaagaaacgactaggagagtgcgaacatcacgttgaggatctgactttgcagttaagcaagcagattctcacgcggtatcatgaggagcagatttggtccgataagatcagacgggcttcgacctggggaacgtggatccttatgggattcaacgttgtcttgttcattgttgttcagcttggattggagccctggaaacgaagacgcctggtgggctcgttcgaagacaaggtgaaggagagccttcaggaatgggaagctcgaaatgaggcccgacgtctcgaagaggctactatggctgccactgctactcaggccatcaccgagctccagcgtagaattgagtctccccacgtcagcaaggctgatgtcgtggaagcagaggccgagattaactccatcaagaccaacctggccacctggttcaaggagcgagaagaggaggagaaggaggagattgccaaggaggctcatgagctggctgtgattgcagaggaccccgatatgaccgatgttcatcataaacctcatcctcctcagccagttgatacagaacgggtggtgcgtcctcatcttgtggagaactttgagcatcatgttgctgatcctgtccatcaccctactcttcctatcacatctacacctgttttggaagaggatgcccctccccctagaatccatcctctggtccaaatgtctcctgattcacctgacgatggtaccaaaacatttacagccactagagatggctacgacgtgcatcccttggttgtgcgacccaccactcctccgcactttatgctgcaggtctggggggcagccaagttgtcggtggagtctgctaccaacaagaccgtggctgtggttcgaagcaccttccagacagctgagcagcggccgttcgagtccaccattgtcgcatctttgggtggtctttgtggcggtcttgtgacatttttatatctcagatagagcatacaatcacgtatgtagtaatgattagaatgaccatgaatgtggagaacaatgtgcaagtacactgtactgtacagtacttgcacgatacttgtaggtacaagcaacgacttggatgctcaaaacaatgacttctacggtatatcagtgagacatatattctggggaagaatgattacaagtacatacatgactcactgaaaaacgtgtagaaagacttattaagacacaaggctcgtacagtaccaggcaaaattaacccagaagtcttccattaactaggtcctacccctatcccttgccatccttctccgtcgagtcttgtttactgtaggtgagtcacggtgttgttgtattatgatgggtagtccttgttaaatcaaacctcataaagctacagtattgtacaagaagttatggtatctactgtacacttacaagtgcattcaagtgccgtatttgtacagtatgtatcgtactcgtaacttgaatagtatgtacttgcgatacatagcacagcatctataactacagtagaaataccggcacttgtatttgtaccgcggcttgtcattggtgctcatttcgcgtgtatatgggataggcaagcatagcaggttttctttgtgctggtcgactcgaaactcatccccgccgcttctcacctgcttaaagccgacacatttacaatctacgaggccggatatgtacgagtacgctgcagctccgaggactattccagttccagtgccatcatagcaaatgagtatggcgacaagtcaaatctgcccacttttagcagcacaaagagactcgctaattgagcaagtgtactacttgtacagtagttacagtaatacacgaatatggtgacccccaatcacgtcggaagttcggttgaactgcacggttctgaacacaatggcttcaatcaaggggagatttacgaaggcatcctgttgtaatattcatttgacattccccccgcaccagatgctggtgtgccaagtgttccagggcccggaacccctctcccggtcagtgggcagaaaaaatatgaaccgcagaacccctttcctagcatctgcagctaccccacttcttcatctaacgggctggttccaatgtggcacaaactggccatttcttgtcccttttatcttttgttcttgtgtcgaaacaaggcgcgatgctgccccatgcaccaatgaatgcactatgagcgcaaatcatgctatgcaggctgtcacaggacaacggaatccagggtggttttgtagttgcctccaattatatgccgacattttcgtctctctacacactccaggcttggcctttttatgctttgactgacgcactcgtacaattctccctgtgaaggacccacacaaaagtgaaggcagtttgcgacctctgtagctaagctcaaacggtctcgaaatacggcagttagacagcgcgaacgttgtatagggagagacacaagaaaacagactcaaacagctatcttaattgaaggggtctcacaccttgtctttgactgggttcgtcctgttgcgggagagtcgtatcggaaactgttcagttctattacggcaatacgaacacaactacaacagttgtggagagtgtatctacgtcggagcgatattgccgcggagcggcagattacagctcaagtaccaatggggaagtttttcaacagcattcaagcacataatgttacgagcttgaggttgtaagcacaatcaatcaagtaattcacagcaaacgcaaccactgtagagctattggagagggcttaattagtcaagctcaaagttcgagacaggaaacttatacgaccccaggtaaaataaatggtcctttagaacgaggtacatagcagaggtctatagtagtaattccaggctgacgatatgaataatcactcacatacttacatgcacaaatgacgtgggtcccccaccggaagcccaccacatgccaataatggcgaatctatttttacacccgcataaaaaagtcagtccagaacagaatagaagccggttctgcgaaatgggtactgtgctgctgtaggtattcaaatagaattcacaagaggagaggctctttttgagaggaaaaaccgtaaccctaaatttttcgtgagattttggtacatcttgtacgtagaaaaacacgcttagcaaggccatcgtgcattgttggggggcatctctagtgttaaatcggtctgaaatgggcttggttcattatgttgagctgctggcgccatgtggagcttgagtccagggatctacagagaccaacgctgctgtggacgatcttcattgttccccacacgacttagagttgatcagacacactatcggggtctccaattatactatatgagactgcgctttttgctctatattctcgatttcattgtgtatcgacaacacctccagcttcacggtgcaggacgatgcatctcagaaagcgaaaaccgaagcggcgactgtttttttgccttggacgcccgcattggttcggtatttagctcagaaaaagatgtaacactttggtagcgcgatggaataacggtggatcaacggccaataacggttttcataaggggctatgacagtcacagaaaatccgactagagtgtactctgtagactccttgacacacccctgcggactggtggcacctctccccaccccctcaattcttggctacatcaacatgcatggaaatcccttggtattccgtaaatgacatctgcaatgacgcaacagctgaacctttctccctaaccatcatggctcatatgcctgagccgtctgtgccacagacttattgcacgtagtacatatacgaccttcgccccatgtaatgtctcttacacaaacacatcttatacaaaatggtcgccatcaagaacaccctcgctctcactgtcctcgcctctgtggtctctgctcagaaccccattgtcgcctctctcatcaacgacattgttgagggtattgctgccgctaagaccgacaacgacatctccgacgaggctgccacctccgaaatccagtctgttgttggtatcatccagcagaacaccgatgtccagcagctcgtttcccaggtgatccccatcgccgccatgggcctgaacgacgacaacttcccccaggttctgtccgccgcacacgccactcttgaggccttccagggctctcccgagtaccccgaggccgtcaagggtcttaaggatgttctccctcactacgatgtccaggaggctctcggtaacgtgcagaacaaccttggtaacgtccttgctcttattaccccctctctccccaccctgacccccaaccactccgagcagtgggaggccgccaccaagaacgtccaggctcttgctgcctcccttggcttcctccccggtggagatgacaagcaggctgaggccacctccgccgaggcctccaagaccgaggcttctgcctctgcttccgccactgaggcttcatccaaggctgaggccacctctgaggctcccaagtccgaggaggcttccaagaccgaggagtccaagtctgaggagtccaaggccgagtctaagactgaggacgcctcttctgccgccgccacctctgctgaggcctctaagaccgagtccaaggctgagtccaagaccgatgcctctgcttctgcctccggctctgcttctggctctgcttctggctctgcttccggctctgcttccggctctgctgctgcctcctccagtgctgagtcttccaagcccacctccgcctctgtctctgccactggtggcccttctgtcgctccctccgcttctcccactgtcaccgctgagcagggcaacggtgcttctgcctacaacctcgccctcggcggcgttgtcggtgctgctgccatggttgttgctcttctctaagcaaaagaactctagtttagtatcgttacaccagctccaaataattaatttatgataatgacatttgcatttgtgctcgtattattttaagtctgacacgagtctaacctttagtgccccgttgaaatatgcacccttaaaactgcgctaatgcagctacttataccagtagcaagttaggagtaacataaaagtaaaataggtactatttatacttatcaaacgatagaaatcacctaccaaatccaataaattaattactccagctctgctttttcctgagcagaaagcttcagggctcctctagtagccacattttttcttaacaatgtcaggaacgcttggcaatgcttgtcctccttgcctcgggccaacctggtgaaaatgtcatagaccttcttgtagtcggaggtcagagctccaatgatgttttcgaggaatcccaggcacagtagatatacttcgtagagcttggtgtcttcagaccgctcgtgtagagtctctgcaagagtaatgcatttcagcacaaacgacccgtccaactcagggatgctagactcgtttgtatgcacaatcaaaagacgtagaacaggcagagaaaggtcaactagcgtgctgttgacctgtcccttttgtagctgtgtcgacagctcatctagagtagaagccagcgaagagaagaagatatcagactggcaaaagtctaggaaaaagaccaccagttgcagcaccttgtatcccttcttttcaaactcgttggttgcaaactttcgaaacttgtcccagttgtttggttgtagacaagccttcaagattgtgcttccagaggcaccagggtaagtttggagagtggatagcgtagcaatagcagccagagcaggtgaaggcgtgggctcatcatcagacgcagaagttgtgccatccacaaactccttgagcactttctggaaaaccttactggactttttgtctcttaaaatgctctctgtgttatcgagacatagaaagatgctgtccagaaacttgggatcgttaattactgtatccagaacattagctccattgtctccaaagatcttctgggcaataaacaagaccagaaaagaggcaacttgatcggtctcgaccacctgaggaagaacatggaggattttgtccgcgtagtctgtggttttgagctttctgatgaaatcgggatctttggccttcttgcaaatctccagcagggtcgttcgacgactactaccctcatcctcgagcccctcagcaagatattccatttcgtccatgaatcgtgcgtttcctccagtctctctcagttcatgcacactcttgatgttcagctcctcctgctcgctctcgtcgctgctctcactcataattgaatcataaatgctttccttcttggtgggcgagtctgcaaggtaagagcggttggcgccatacgttcgtttgttggtggtgacagaaagaggagctctaactggctcttgggagccttgtgagctctcgaaagaagacccaaaactcgaactaggtgttggtttgtcctgcaagcccatctgaatgtcgccgtcaaccactttattcttccccgtcatcttcttggagggtgtactggtacgcaaacccctaatcttgcgcttctgcgcagaaccaaagatcgaagtgccactgagtccgttgttctcagcagaggcaaacaatctcttgggtccgaagactatccgatcatccttatccttctcagcctgaatgtctaccttcgtttgtgtttgcgtatccacgtccatgtcgttctgggtatcttccaaatcaatgtcaatagccagtttgttacccgtgtctacaagctgagacgaaaacagtgtctgcgacgatcgaggggatattccattggatgagccgttgctcgaacttgatttcaccagtgtatcttccttgtctggagcgctgttcttgactgccgggctcgatgatcgcgatctcgaccgagtgaggcggaccttggttgttggggttgccgtctgacgtttcgctggcttctttccctttgctgtaggtgttcccgtgttcttctgggcttgcggtgtggcagtagctgtaggcttcccagtctgccgtttggtcctgggtgtatcagaagctggcgattcaaatccgttatcctggctctcatgaacacttgtgtcgttgctgctggtactgtccttcgtggaatttctcttggcacgtgtagcagcgcgccctgctgatgttggagggtctgctgttgctactggctcgcttgaagatcccccagatgtcatatccgcctttttgtagggctccgtgtcgaaaatactggctcctcgggtccgtctaaatagagtcggtcttgttttcgaatctctcgtcgccgtaggttttgtgacgcgtcctacgagaggtgaattggaggctccctggttcggatcttcactcgctccgaaatcaatcttcgcacccgcacttttcaacgcgaccgaatcgtttctttccctctctcgcgttgtgggagtcgtgtttgagagcccgggagaagggctgtctcttgcgctcagaaacgaactcatcagagtcatctgttcaggctgacgtctggtagcgctgccggtacgcccgtatcgttttgttgtccgtggcgtcgccattctccgcgtgtctgtgtatctgctggtgccctgagatcagtatatcgtactgtattgtagtgaggtcaactgagcaccgcgttaatgtcgattgttatgcatgaggtttaatattttgtagcgataaaaagccgagtttaaaagggactatccataactgagagctcagaaagcctctattaaatgggaaaaaatgtgcatgatacactaggattggtggaaattctacgggcttcgtgattacaatgatactcggtagtttgcctacatacctttcataaaaaaggtcgttatctatctattgtgtagtaatggtatagctaaaaaacatctactgtctcagggcagcaattgcctgcttgagctggtcgagaagaacgtcagtctcagttttagtaccgatggaaactctgagagcgccagcacagccaggctccttgccccggaatcgcaccaccacatctcgagactcggcaagctgctcgtacaccttgaaggccagctcggtgtcgggctcaccagccttgttgaggatctcaaatagcaggaagttggcgtccataccgccaatgactcggccgactccctcaatggtgggaagagcgtcaaggatacgtgctcgctgctctagaatgtccttggtgtaggtcctcatgagcttgactccctcctgagacagagcacgagcggcaaactcggcagcaggtgtggagatgttgtagggagccttcatgttattgagcagagcagcaatctcgacagaagaaaaggtgaagcctgctcggacaccagcaagaccgaaggacttggacagagtctgcatgaccacaaggttggggaattcattcaccagggtagagacagaggctccctcccgggtgaaatcaatgtaggcctcgtcaacaactacaacaccgttccagtcagcattgagcacctttcggacatcatcctcgtccacaagcttggcggtggggttgccgggagagcaaatgtagagcagcttgatggtgggatcagcgttgagagcctcgatgatggcatcaggacgcaggctgaagtcggcagccagagggaccttagtgaccccaacgtcattgatctgtgcagaaacagagtacataccgtaggtagggggacatgtcagcagcttgtccttgccggggacacagaagcatctgataagagcgtcaatggcttcgtcagatcctactcccataaagatgttgtcaggagtgatgggcttgggtacttgtcgctcggcgtttctgagatcgcacagaagctgcttgacgaaattctgtcgaggatcggggtaccggttcagcgagtactcggactcctcctggttagttttgatggcaggaccgtgggggttctcattggcgtcgagaagcactccggagtcgtagtcgtctcgggcgcatctgtagggcaccagggctctgatattgggtcgtgcgagggtctcgaggttgaatttcgtgttgggcatgtctggaaagtcgatcaatcggtatgatttggatattcaacgcctgcttggggttatatatctgtgagtcagtatgcaagttggaactttagctctgaatttagatccgtcaattttctgagagctgagagcagatgaacaactgtgtcagtgttgttggttcgagtttcaacaggtgaacgtttaaattgcgaaaatatcctcgacggtatgttgtaggtgtaagtatacttgcaatagtatggtataaatgccacaatatataccgtaccacggtacaagtcccggtactcgtagtactgtacatactcgtatttgtatgtgattgagtgttgctaaataagttcctcactacataaacttgatccttactactgtatatactgcttatcccaaaaaaacatcaccctagccctgcacacacatacctaaacaaaaaatcgatatcgtgagataacatcaaacgacgatgacaattgcaactctcgaagagacgcatacagacgtgagtactcatttccgacacccctacgaacgccactaacgcagaaattcggtttcaagggtcttgccggaggacaaatacaggtcgtgcctggatggggagaggaggagctgggacgaaagctggttcagctgttcgatgtggcaaattcgagtggactgtttgtggctgccggtaacgacgacgcttttgtggtgggaaagttgtctgatctccacgagattggtttcacgtctgagttcaagaagagtcttgaggacaaggtgaccaaacacaagctcaacggaaaaccctctcatgtgggtttcaccagtgacgagaagagcatctacgccggagtcgatggtgagctcagggtctttgccacagacaagcccgatacacagctcaagtcgattgtgttgggagacgacattgcgcaagtgctgcccaacccgcgagtggcttccgatgcagctgtagtcactgccaatggctctctgttctttttggatctggccaagggtacctccaagcgcattgaggtccctgagtccgtgacacgtgcatcctggtctcctaaaggtaaacagcttgtagccggaacatctggaaattgctcaatctaccagctacgaccagatggaagcactgcggcggtggtagaagcccctacaaacaatgaggatgaggttctttctggaaccgcggaggtgacggagattttgtggctcgaaacccacctgttcttcgtctcttactccaaggttgacgatgaagataccgagtcttcgtcttacttaatcttcagagataagaacggacccaccacgtacaagaaggcggaagaagacctgtcgcctcctttcggtgatgcgtctcgtggcagatcgtggttttctgctgttctgagagactatgctggtcttgattacctcatcgctacaaactttgctccctctacggaaatcacaatgctcaccaaagacgaaattctgagagccacagacgactccatgaatgccaccatgccctacacagatttcgatacctccgccattggtattggcttggatgtaacctcaaaggacgatgtggacactcctattccaggagcctcgaccagcgatccccttcctcttttgtggatattgaacaacgaaggtagattagcgggatggcacattgtcagtctggatggaattaaacagcacactgctggtgtggagcccttgcagaaagctatctctgaagccgccaaggaggcttcaactgctgcgagtctgttcggtggtgatggaggttcatcccaacagaagactgcttccccttctccctttgccgctggacctggcactgcttctccttttgctgctggtgcgtctccctttgctgctgatgcgtctccctttgctgctggagcttctgggtcgccttttgctgctggagcttccaagctgagcttctccaacttcaagaaccccactcttccagatgaaaaaccgaagtccgagaatactcctactttcggaagcagcaagtttggtgacatgaagtttggaaacagctctttcggctcgtcgtcgttcggtagctcgggccctggaggatcgggtggagcttttggagctaaggtcacttttggcagcggttccaatcccaaagagccatctcctgtccctgaagctcagtcgactcagccaacatcaacccctactatccaaaagatggatgatgacagtgacgacgagggccacaacttcaagttcgatgaaagcatggctgatgacttggaaccaaccactgaaggcgaccagaccgatcagctgttggctgctctggcaaaggacgatgcgcctgcggctaaggatgcgccgtctaaggatggcgattctgctttgtttgctcctttgactgcccagaaaggtatggggctcaccagccgtcatgctaaggccaagaaggatgacaagaaggacgacaaggaggatgacacgaaacctgtaccttcatttggctttaatctcaacaagaccagtgcttctgccacaggtaaatctaagtttggatctcaagcaactggtggaagtgggtttactttcggaaaagattccaactctgagtcccccttcctcgcagccgcagcttccaaccctttcgctggtaagggtttctttggcagcacagagaagaaggatgaggcggaggaaaagcccaagactgactctgctgcctctaacgagcccaaaatcacggagctttccagtggggacgatgagggcgagtccaagaagtctgaacaatctattgcagacaagcccaaggagctacaggtcaaggatcagtctcaacccatggagcgtgtgtcttcgcgagaaaagacgcccatcaaggagctcataaagaagtttgactcgtcttcttctcaggacctcaacaaggaggatctacagaagcttaaggccgcatctggacagactaagagcacccccgaggtggctgtcgaggacgaagatgatgagcaggaggatgatgctcttgagaagctggatcaggccagttttgccaagcatacaactcacggaaagtccgatacagaccctgccaaattcgacgacgatgctcaggagaaggcggctcttgagaagctggatgaggctggtttcgctaaggaagcatcttcgggctcttctggggaagctcccaagacttctgttaagttcgatgatgatgccgaggaggatgaggcgctcaagagactcaacgaggccagtttcactaaggaagccaatggcagttctaaccaggaaggggactcgagctttgcacagttcgatgaggatgacgagaatgagtttgatgagtttgacgacgactacgaggattacgagggcgagtttacggaggagaatgtggacgaggaggacgaggaggatgccgattacgtgcacgtgcacgatgaacgaaaccagaccgagtcgattgacgagacctatgagtttgatgatggggacgacgagcatgacgacgatttcgacaactccgttgttgatccctctctcaaacctcctgctcttccggtctctggcgtctactcgggctttgagcctgccagctctcttcctgctgctgctgttgagagagctcctatggtgtcaacagagactcagaccgaaccagagcctgaacctgctcacgaacaacccgaacccgaacccgaacccgaaccgttcgcgatgcctcttcctgttccctccatgaagatgtttgaggattccagcaccgagactcccaaaactctgggtgctgctatggaacagatctacctggaggtcgaatcagagtttgagactctcacagagaattaccaccttctggagacgtacctgagagaccaggacgctttccaggaagaagagtacgcgctcagcattacggaggtggaaaagtggagacttgggggcgcttatgagctggcaaatgaggtcttcgaggaactggaaaaggtttctccttatgctgccaagtttgagggtgccgacgatgacattaacaagtgcaacaagggactgggtgttcttgaatacaagattgcccgttaccaaagtcttcgacctaaggaggagaaagaggaggttctccgccagcgagctctgtcggcacgagagcaaaagctcaagaacagtcttcgagtcaagaccgagaagattagatctgatctgattgaccttgaggctacagttacccagatgaaggcccagactattttcctcaatggaggtacttattctacctccattactcgaatccaggatactattggccgtatcactgagaacttccgagagcgtctcgccaacctggatgccattgaggcgaccgagactctcgataatctctcgcttgcatctgcgggagatgtcaaggcaattacaactggcgatagttcttttgttggtcctgacgagtcctcttattttatcgttccatccgacgccccttttgctaacagcttccgacagctcatgggaggtcgacaggttatgtaacgaaatcaatgtatttaatggtggttgttcacttgtgtatccgtaaaagtacgatttgttatgtgtttccattataggtcttgtatttgtgtacaaacaggatgtggccaacttccttacagtttctgtcatgtcatgttcaatatttcactcaccacactagcttgaaatatgcttcatgcaagatgagtatgggggatcggggttagtgatatatttatgggatggtattggtgatattattataacaacttgtacaagtacaagtatgtgctgttccatgtgtttggctggtggtatgatctagactacaggtacttgtattcactatatgcttgatgtttgtgagtacgtgtagctacagtatgtacatacatccatacagggagaagacgatgcagttgtaggacgcctgagtgatgggatacttgtaccatggcagatttatactcagtggttgtagagtgttgtatgagtatgtacaagtgtctgcgtcactaatcaaggatacctaccatgccactatgatgtttgcaggaggtgtacctcggcagtcatcaaaaaatggaactactggctttagatcttgttgtatggcatcgcgcctaaaaaagaaacccccttccagcgagctactacaagtagttgtagttgcgggcgttggataccgaaagtcacaagcacatgtcgaagctctcatctgaaacaccgacagtcgtctgcaccccgcaagtctcggttcgtaccagcaccaatgttaggcagaactatacacaagagggcggacgatcacttcggcgttaggcaactgaaggctattttcggctggtactgtaggggacagaggaaacgcaagtgattagtaaatcggataataggcctgttagtttaccgaaatggtgggggaggggttccgtggatatcttgaagttatggaggctgatcgttatttgtggggatggatatcattgtatggacatactgtagctactgtataaacaacggatcttacacctgcctcttgtatgcccattgcttgatcatctatcgtgttactgtacatatacaatagatatagggaagaaaagccggaagtagagaccatagtctggcagaagtaacggcctcgggtcgagagaactataacaaagtccaacggcgggtcttagaatagccccaaggatcacacagttccgcaatccagtttcacatgttccgttgcatggacttttgcatgtctactgttgctacgattcccccattgcaaccacagtttggggttaccccgcattatattagcatgattacgaaagagataagtatcatatggaacatgtgaagggtagtatgcaggtccggcggagaaagagaatgacgttttcattaagcgattcgcttggcggcttgtgggggatgtgacgatacttacggtaaagaccctgtgtgagagctggtactcgctcgttacttcgctgatctgttgggccgtcaatcgaatctcgtggaacttgcattcttcttaactgtgtctatacaagacacctaatgaaacatacaagctaccgaaatcattttactcgtactgaccggtacggtacttgcacaagtagtgaaacttccgaaaatagccagcctcatgcatcatcgcttcaccccttctgttgacctcaaaagcattccaacggtaaaaaattataacgccgccaactggatggttgtgacggcgttgaccaccaatgtgtgggggctggcggtaggaccgagcttattcgtcccaataagctctttggatttgattctttggggtgtgtggtaaaattcacatggggaagaacacggtggcagtttgaggcagaggcccagcgtgtagttcctagggcatgaatataccgaactcatggcgcagaattgagctgaatgcgcaaaaagctacaggatcaaccgcgttagaaatgccgcaaatgtccactaattccccggactgttccaaatgattctgtggggataaatctcaaactgggttaggctttgtcacgtttctttgtgtcgtgtcggttcgtccggggcaatgtgcccacgcttggctgtctccctacacctcggtaaaaactatcacatgctgcccctctcgagcaagcattaaatgcatatagtcaatctaacgacatatatataggtagggtgcatcctccggtttagctccccagaatatctcttattcattacacaaaaacaacaatgtctctcaaggtcgacggcttcacttcttctatcatcttcgacgtcatccgtgacggtcttaacgacccctctcaggccaagcagaaggctgagtccatcaagaaggccaacgccatcattgtcttcaacctcaagaacaaggctggcaagaccgagtcttggtaccttgacctcaagaacgacggtgacgtcggcaagggcaacaagtcccccaagggtgatgctgacatccagctcactctctctgacgaccacttccagcagctcgttgagggtaaggctaacgcccagcgactcttcatgaccggcaagctcaaggttaagggcaacgtcatgaaggctgccgccattgagggtatcctcaagaacgctcagaacaacctctaagcgcatcatttattgattaattgatgatttactatattgatttcgcaactgtagtgtgattgtatgtgatctggctcgtaggcttcagtaaatactagacgggtatcgtacgtagttgtatcatacatcgagcctgtggttacttgtacaataattcgtaatgtagagataccccttgatccattgcctgtttctaacatacaatgatctccacgcaataatcccactcttgactaaaagttgctactcttgcacggttacctcggcatagtcacgcctctcttgtctcgtctcgaacgcacaaagtcaattgacaacgccactcactcgagtgtgccccaacagggcaccatatcgactaatttgaggccaactagggtgattttggatggaatttgatcggaaaaaatagctgcagaaattcctggagagaaaaattgaccgcatccacatggtttgaccaaaaaatcgtctccatctctgtgctcaactctcctgacgagatatgcgcgcgcacccccacatgatgtgattgatctcaacaaacttcacccagacccttatctttccggaaaacttactgtataagtggtcgtgcgaacagaaagtgtgcgcactttaggtgtctagatccgattgttctcgttctgataatgagccagccccgcgaggcaatgttttttacaattgaaaacttcgttaaccactcacattaccgtttttgccccatatttaccctctggtacactccctcttgcatacacacacactgcagtgaaaatgcactccgttagcaccgttgtgattggttcagggcacgagtttggtggtttaaggcgcaactacatcaatatgaaaacaggagacgctgaaaaggggtaatatcggactgctgctatgttgtatgtactgcatgacgaattggtgttattcaagaccgtggcacaggttgctgcggtacgagacctggtagcttctctaaacggcatgtctaggtggacgagtatggagaagttaggtacagtacgtacgtatacgagtacgagtacgagtacgtagtacgatacagggtacgtagtacgatacagggtacgtagtacgatacagggtacgtagtacgatacagggtacgtagtacgatacagggtacttgtacgaagacaacagtagagtgcaaatatcaaccaacatggccagagcgaccagttcagctttcaggggggcctctagcacttgtcaccatatgtagccgtgataattatgcagtgatgtgataactactgtacaagtagaagtaatccggtggtgctggtaccttgaattgagtctcactatcggtttcagcaacaccaaggacttcatagatagtacaggttgaagccagctgctggtattccaccagcgtctaggccgtcgtccccgctacgccaccttgttgagtaaatcactcagaccagcatgcaccttgacgtagaactcgtcgtccttggtcatgctcacgagattcttgggtttagtaaacgcctctcgtctgaacgaatcggcccagtcgctcttgtccttcatctcctgatgcttcgtcacctgtgtcttgatccatcctcccatgctttcgaatcgctcggtgatgggaatccagttgtccatcagacgcttttcttcccccagacagagaaagccgtactttcgaatcccaccacgagactcgttgtcgttcaccttgaacacgtaaccaatggtggctccagatgagtcgccaaacatgagaggagtatccgagaaggtggtttcactactcagcagcttgagacaggcctttcgaaccttggagtagtcatcctccccgacggcacattgagaagacacgtatgtgtgctcgccaatattagatcgtagagttgtggcatcatttggcaggatcagctggcaatttgcgcacgtcgaacactcgtttggtgtggtctccttcgttttctgacaacacagtatcgaagtcgggccatgcaagtcgcagaaatgtgcaaaacagagctggttagtgcttgttgtgttcgttgcaacccttaggaagccttatcctctccccatactcaccagtagtgccatgatttggtgcaaaaaggtgttggtggatgcgttaatgaaagttgttgttctgcacgtctgccccagattaagaactttatcatgacccatcacagcaaaaaaaattgacaaaaaattagcgatgcctggtttcgatccagggacatcagggttatgagccctgcgcgcttccgctgcgccacatcgctgggttttttttaattgaactttttttagaatctcccaagctaaaatcagtgtcacgtgaccccttaaaactcagatttttgaagtgccattatgtcatttaaaatgcaattaagggtggaaatgagtagacaggagtgctaaaccggcaattctttatctggtaggagggccttttttatgataatttgggggttaggtcaaattcgatgcgtcgttatgacatctaaaccgggtacaagtagctacctaaagagagtgtgttccagtgttggtcaacaatggtatggtacttgtacttgtacttgtagacaattaaaccaaaattataccaccgactatcaagcgcagcacacacatagacatgcaccttctgtagccgcttcatattatttctcatatcgggttgatgtgatgttattactgcatacacgtagacctccacttacagagacagaactgtcatagtttcgtcccaagaagaagataggacacccactccgtctggggagacctttactttggtaacaggaccaagatgcttcgtgattgggccgaggtaggtgcatttgatggtgtcccaagctaccacttcacctgtgtcatggccacagaacatgatccgtcctgagggtgttacagccaccgagttgacaggagacattatgtctggggcactataaatgttcatttggcaatcagttctcatgtcaaacagtcttgcagttgaatcgtcacctccagagagaactgcatttccatcgggaaagaagtccactgaagttacatccttattgtgcccctgaaaggtctggacacatctggcgattcggagatcccagatcttgactgttttatcgttggaagccgtggcgacaatctgcatcttagaggggtgtttggtcacagaagagacgtctcctagatggtcatacagggtcgaaacacgtcggcctgtattgacatcccagatgcagcatgtcatgtctccggaggctgagatgatctgttggtcagtcaggaaacacaagtccgccacatatgcagagtgtcccttgagaatggccatgggctcgcttttggtaagtcccttcattctggtcgacgaccctgaaccgtagggaacagaagggtctgtctcatcagccgactgagtcatggagtggattgagaccctgttatctagaccacccgatgccaggtagccacacgagggaggtaatgcacaggagagcacgtagcagcttggaagaaggaagactctggactttagagacgagtaggcgtcccacatgagagccagaccgtccatagctacactgagcacatattgtgagttggaggcccagtcgcagctgtttatcttgcctctgtgtcccttgagtttgtgtcgcaccttcaggggggttgaactgatgggccggaggtctgtggcaagacttggaagggtggcattcataaattggcttctctgatgaacaatgttctctctcatggcggcacatttgcctttgagtaacgacagccgctcatggagatcttcaacggtgggggaggggggagtatctggccggagaatatctgtcattttcgcgcgtggatgagttcaagttggttgcaatttctagtgtgggggactccaccatgcaaataccaattcgtgtctgccacattgattccccgttatagctgcgtgcatgcttactgcatgagctctgcggagtagatgcggagtagatgcggagtaatatacaatatacatatagcaaggcgacacaaggaagggccacaaacggaacacccaaaaaatttacataagtgggtcttcaaataataaaacgtttggcaaatattatcattactgtgctgatcaggaggataaaagtatagtttagttggcatgaaaatattgtgtgtgtgttatcgtgtgtaattatctcgttgagccccacagatgctccaccacttgacttgttcctatagaccagatatggtcaattgccgaatatgaagaaattatgcagggttcgaagatgggaggtgcaatgggaccactttttatcaaacggccccaacagcaacgaaggaggagactcagctgtgtaatctacctttatgatcttcgctctgtagactcgctagtataaggtaccgggtagacgacgagtatgtatacatgtatacatgtgcttgtcaccaccaatctaaaagagcttgttgaagtgacggtcaggggcgtatgaagatggtgaaaatgacgttattttattagaatgcggaggtttgtgcttgctgtagagaaccgacctcggcctattatcaagtgcagcttctcacacacacctgtagatcccactggagtctcttcatggttacaattctccaaggggtggaggaagcgattaggtggagtagatttacacaatttcctgcacaaatggcactctgagctgctacgattcggaccgtcaagtgcccattacccgatcagacctgctattgtgttcttttcaacttttccagcaacaccaccgccaactttatccgttgatgtaacactggcaatttgcacattggaaaaaggaaaaccatactgcagccggcaagctcaaagtcactacttgtaccattggcgcttctctcggccgttgtaacagcttaatggagccatcgaagggccgtagcaactcacaggccaagcctattcaagattgacacagagcaaggtcttgttatgcgttctgtcgaggtgaaaccaatattttttgacagccaaaaatagcgggcaaatgcaaccaattaatagaccctggaagtcttcatgcttggccttgcacaccttaatctacaccaacaagattctctcatgtaatgagacaaaaatattttatacgatcgtcagtgagtcaaggcaagttatggtatagagatgtagaagtagtcccacagtgtgtacagggcccgacattcttcaccctccaaggtacaacattggccttgtactatgtactgtactgtactcaggagtagcccaaaggaaacgaaaaacaaccctatcgctgtgttcctgccgtattccatctccccgcgcctatcaaactcggttgatcgtcgcttctttgttaggtgaaaaatcaagggtctatgtttaaataaaaatgatggcttatatagagtgcgtgggcgagactgctcctcgaatccgctcctgctcttcaccttggacaccaccactgagcaccacatgcggcaagatcttgtccaaatgacaccacgtgttgagaggcattcggtacatggctagcttctccgtcagctcccgcagatactggtacgtccagtcgcgcttctgcccattgagcactccgagcacgtggaatgagttggacgagtctcccagcgtcaccttggagtaactcctgttgttggtgtcgacaaacatctgaccagtgatgacaggggtgcgggtatcgagcaggggcatcagcgaaaagtcgcgtctgtacgacaggtctagcctggtcttaccaatcggcacaaattgagaagatgcattcatggcccattcaaccagctggtttcgatacagcaaaaagaagcggttatctactatgaagggatgatgctgatgttgcggatgcgtggggccatggggggatatcgttgaacagagacggaacgtcttactgttggcccagtcaacccagaagaagtcattccgcttcaacacagggtcctcaagcgagttggaaatgcaaataaaggtgtcgtggccgtacacaaatacacgggcggactcggaacacggcatgtgtatgcgaatagattgtgttttgatgttattccggcgacctggagcaatgcacttttgtcgcaacagctcgtattcctcacacaagccaatggagccggtactggagtcagaagtagagccagcactactgctgcccgagtgacccaaccgatgccattccatttcgggagacatgcctggagccagtttagtggagcgtaagcgaagcagagccgtgagatatccgtcgtacatggccttggacacgtggaagcggcgaattacacggtcatcctccagtatatttctaactactctccaaaaccacgttttgcgggcgtaattgagttcttgaacaccgtctaccggaggggtgtacacatttgatgcatagtcgccataggtttgtggatagatggggaagttgtgggtgaagacaatctggcggcgaaagcacagttttgtttcgtattcgtcggatattgctcgggatatcgacagcgttccgtcagggaagatgtctgcatataggcttgcttcgggtgcgaggttgtggttgatggtttggaccggctcaggctcctcggcgtactctactaacggcagggaggccagtccgtctgtgggagaggtcagatccagggcgtcatggtaggaggtgtggtggtagtcggcttggtgatggtgtcgtgcatgtccatgcatggtgtctctacgacgcagttcggccatggcgagggagagccatcccgctgcgctggacccgtcggctggttgcatccatggtgcacagagagccctggcggcggtgagagcgtgggagctgttgtcgactgcttctcttagacagcagcacgagtttcgcaggttgtggagatcttcaacagaggtaaaggcgagaatcacggctatggtttctggaggcaggctgagcagggacatgcccaggaatcggtgcgtgcgagaggttggcgggtgtgcagcttcgacaagatgctggaagaggtggttggtggtagtggagctagtatggcgttttgttggccgcacagtatagtctagctactggtagacagttttagatatgcaaaaactttgaactgtttaacggtgcattaccagtagctacttgtatggtctctacaagtagatttgagacgagtgggaaatgggttcggcggtccccgacagttgctgtgaagcttatgttctccgtggacggtgaccggggtcgtttgactgtgttcgcctgcacataaatgtctcgcttgtctgcgactccacatctcatcaggctaatgcctagactcgaagctagccattgttgagcggcacccagggttgcaatcatcatgcggcgccaccccgtattatatatagtctttaccgttatgatagggtggcgacggtaccagtggtgtagaagaggtacagtagctacagtgatatgtcgatgggctgatgaagtggcccaacaggtgcatactgtactcgcaccagtgtttcgtacctactgatatctgcaagtgcagatggtgtctcgaacattgagcagcacccccctcagaagctactgtaaccgcggtgtctcagtatcaataagtaacatcaagctatcgatcacgtgatgcaggggttgcaaagtatgctgataggatgtagtgtaccaatgtatacagtaactgcgaccaacagccgttagaaccacacggcaccatttactctgcgggattacacagataagtcagctgatcatgtccataagggcaaccatagccaacagtagctaagaaataaacaagtcaattacaactagctacaggcagtaatactcttatgccatgcgatattgcgattgtctaaaatttcagtatctcctgctttttattttcgcctctcgctcacgtcgtacaggtcgtatttccgaccccgtaaggtatcccaaactctgggtcgtcgcttatctcgttctaggtggtggcagagtttacagcctgtgcatgagagaggcacactatgcgcacagggagatgtaattaaaactcatctgatcaaaacaagggtttatctcgagaccgtctcaggagcccccggtattccactcgctcaaatcgtcgatcgttacacatccatccattcgcttcaccattcgttaggccatgcaaatcaccctaacacaacagggactgacactacagtctcaaaacggcacgagatcactgcttgatttcgctaccaaatctctcaccacactccaggacgatacggactcacaaaatgacacagatggagcctcggtcgatacagaaagcccgtctctagagtgcctgggcatttttggcatctttcctattgatgtgcactcgctggcagtcatcaccaaacgagaacaggttgctactctgcaaaatgctcccctctacaagatcaccggggctctcctgattcctctgtcctaccagcgagccagagccgtttttgaagcctctcaaaataacaccactgccgaaccgcgacggtccacagactccaacgagtcgagaggttcttcggtcgctgattctgagccctcagaaaccgaaacaggcacaccttctcctgtgtctccctcgactctcaagtttatcagagagtgccaaaaattcctgtcttcaggggctctcttttactctcctaagctcaacctacatcaatctctcaaacagggtcttttgaataaggagtcgaaatgttcttcatactacctgaattacaatagaaacagattgttcaaagacaccgagtttgagctcaagataatccaaggtcatgtgggacaagtcaagcccgaatccagcaacatctccgtggtactcatttctcggagatcacgacaccgcattggagctcggtatctccgaagaggtattgacgatgatgccaactgtgccaactgggtcgaaaccgagcagcttctggttacacccaagtacattctttcgtacgtgattgtccgaggttctttgcctgtcttcttccagcagagtccgtataagctaaaacccactccccgtgttctcagaggagccgaagctactcgcaaagtcttcaacactcatttcgaccgtattgagagccactatggctctgttacaggcgtcaatctggttgaagcgtcttcgacctctaacgagttcaaggttggaaatctgtacaaaaaactgtgcgagcagaacggtaaggagctcgaatggtttgatttccaccacgcctgcaaaggtatgaagtttgagcgtgtttccgagctgtttaacagcgatgttgtgcaggcaggagtcgacaactttctgtgggacggtttgaacctgcaaacgggcaacccaacgtctgtggtccagtctggtatcttcagagtgaactgcatcgactgtctcgaccgaaccaatgttgttcagactgagattgccaaaagagtgctcgaacagcagctggaagagctcaatcacgatgctgacaacattgtatcatcggcttactaccacatgtgggccgacaatggcgatgccatttcgcgccaatattctaatacgaacgcacttaaaggagagttcactcggaaccgaaaacgagacttcaagggtgtggttacagatgtggggctcactctcactcgcttctactccggaatggtgtccgatttcttccgccaggcgctgtttgacttccttgttggcaacgttgatgagagagtgttcagcgagtttgatgagacttgtgccagctctgatcctcgcatgtactcgaaatctgcgatagaggtggcttcagagatctgccaggatgatgtgatttctggctggtggcttgagtcgctccaaaacagctcaaacaagtatattgtgctgctcacagacacatccatctacgtgtgccagttcgactttatgaccgagcgtgtgagcgactttgaaaaggtggatgtcgacaccatttccagcgttcaattccttggcagctcgggctctcaagtggtcatttccacgtcggacaagcagttccggctccgaaacccgacttacaatgagcatatgggcgacaagctgcgccagtactgttcggagagagaaattgaagttcacgatggtgacgagcagtctacgacttttgtgtcgaggatggaacaacggcttaagcgactcatttgggcctaatgtatttattaacgaattatgactagaacgcatagggtaagtaatggcctagtaaatcgccaactaattgccaactaatttattaagttttgagctctctaaaacgccggtcttgtggcaacaaatgagcaaacaggacaaacaaaagaacgaactgaaaaatgaccgccattctctacaacgaacgtgactccagtgttcgatatcatttttcacctttcgttaccgtgaccacatatactcagtccatgccacgatacactcagtagggtaacgtcagggtaaacaccaccaaacatgtctcatgcacagatagcaaaaaaattctgcatagagttcagctcccaaatgtatataagcacccgctcacccacacccagttttcttctgtaagtgacgtattccataggatcatttctataggacatgtctctcatgacttcttaaaagaagccacttattcaaacttggttgatgagatagaacctgcaaaccccagagtgagaaaacatttgtttgattgcttgtccttgtgactcagtcatcttattattcccggcgcgcaagcgttcaaggagcgatgatcttgtccctttgtttgagcctctccggaggagtgacttagggtgggtttgtatggcagtctgacaagtcttgagaaattcttttgttgtttctgtgagcacttcctaggagtccatggttacgtcacacttagatagaaaagatatccattaagaacaacattgagacgagtagaagtgcaataggtagcagcctggtacatgcgaagtaagggtaagaatacaattgtataccctcaccaagagcccactcggcaaaactgataccatgtagtaaaaacaacttgatcacagacattctcttgtcacgcatggtgcgtatgaacttctctaccagtctcactcaatatacaatcagttaattaaataaatgctgcactcccatttcgaagcaccgttagtatctgggagagatagcccccagtaagctttttcttctgtcttacaaggtaggcttcttccagtagtactgtttgtggacctttctgcaagaccgcacgccagcgccgcccttggtctcgttgaccagtttgacccggtccttatccgagtctcgttcgggcacgtagtagtactcctcctcgagcggcttgcctgatgcgtctttgccctcccggtggataatgccgatgcagtcgatgtcgcgcagaatctgctgcagctgcgacttcggcaccatggagatcttcggcgagactgccattactgtctgtaggggtgtgcatgacagacgcgagaaggccaggtggttgcacacgaggtttcggatcgccttgagatcgatcttggaaggcgacagggggatctccggagaggggctcttctttcgcttgggggtagaagtcgccgtcttgggagtggaaacactcttgggagtggcagcaacagccttgggagtcgacttgggtgtagacttagatgcggccatggtcacctggggcacgggtgttgtttctcgagcatgagaagccatgacagcggacggaataacaggcttgataggctcggtgggcttctgaatgggctcaacaggctcggaagactcggcagacttttccgaaggcttcttgacagccttaggctcagccttggtctcgatcttctcaggggcattctcaataggcttgtcagcaacaggcttgacggtcttatcaatggcgaccttctcggcatgcttctgctccagcattttcggcttctcaagtcgtccagcaggccgagtgacctgtcgaaccacgttctgtcgagcaacgggcttcatcaccttaacagttttgagcacgggtttgttggaagccttggcagagcgtttggccgaggagggggtagaagagactgtggtaggggtagaagtgacagtcgcaggggtagagacagcaggagtctgagtctggttctccttatcaacggcaggaaagccagttgtggccttgatgggctcctcaaccaccttctgcttcttgctgaaatgagtgtcagtattcttggtgttgagatcagtcttcatggtgttgagcttgttgtcggaaacactggtcaacggcaccagctcctcatcgtcggtctcgtcggtggtcatttcggcatcttcatcagcgacttcctcgccttcatcagacaaccgaatcataaaccgctctcctcgaacatcaaccaggatttcggaagcgtcaacttccattctgtcgttcttgaacaagaaggtgccaaacgaggaagaagaacaaggggcgttctcctgaccatcttttgtctcagtggagggctcgaaaatatctccatacttgagtttggcttcttcaaggagagtgacattctcagtggttctgaataccctgccactgctcataactcggcacccgttccagcccgaacacgaaatggcaattacgtgacgctcgaggtcgtaccaggtggtcacatggcgtctggaaatctgtcggttgctcttgctaagcacaacctgagactgcagagaggaccgtccaatggccacaggggggtagtactcgcccatgatagcgagtaattcctgggtggtcggcttggacagcaggtctttgttttggttgacccgtttgtccatgatgagagagttgattcggttgggggagggtcgggtgaggttgacaatagggagggaagtaagagctgttcggggctctctagaaagcattgattggagatggagtttgtcgacggtgtcggcggccaccgcttccgctccagagacatcgttagacacgtcagagttgatggaagtcatggtcacgtccccaatgtcatcttcactgtaatgtctaggacaaggagacgaaggagggggactgttcgtgtcatgagaaacaggactgcttctgttagtgtttgtgtccttgccaaaggcggttgcatgactccgtttcacaggcgaagaagacatgattccgggcacaagaacatcgtcactttcgtctctgtagacgtgagtgattcctgtggtttctccagccacaaacttgcccattgctgggaaggcaggaagcagcttcttggggggactagagggaatggccgtgtccatgttggtggtttttgtgagagtggacaggtggtggtggtgttgttgtaagaagatgggaagtattgtacgcgttaaagagtgtgggtttgggtacatgtggtgtacctagttgcgtatatgtatgagacgtgactggcaatacgcgcgtcaaacctatgtgcgaatataggttaatgtgatggtaggtaggcagtctctgaaccccgacatagagacacaattgaaaaagaggtagagatgactgccaatatttcccccagtttactatacttccatcttttaaaatcaaaatccaccaagtatccgtagagttacattagttcgtctctagcccatgttgcgctacgtggaccgtgtatcgcacgcgcgtcaaatcaattttgatgtttaaaagacatgaggttgagaagcgctacatttcgctgcttaaagcaggtcaaaatcgctgtttatgtctggaaaaaaactcttatgcctcgtttaatctcttgtaacgggtctaattacctccatcatactccttcatcgcgttaccaccacaacatattacttgcccgcatgcatattagttcgcgactctgatgtcattttaaactttcgtgtacatgtcccaacttggctgtccggggttagggctcatcggaatgacgttggaaaataagctttctagaagttgagaggtcacatgactacacttcccaattgggaaaaaacagtcccccggctctgctcccaagctctttgaaaattgattcctacaactttttcctacatacacgacgacactaagccaaaatgaccagtgagtgctgacggaatattgagatatggagagaccgtggagagcgacagacggaataacgacgacaaaaattcgacgggcgacattcgacatgcgacgggatacaggacggaagcgtggcctcaatcgttagacgacatggaggtggtgtagtcaagaaggtgataatgcggcaatgtgtggcaatgtggcgagacatttctgatgtggtgtgctttgtttttgctcactgagcggatttaaccaggcttcgatcatcattggtcatgtttttttttgagccatgggtcacacgaccaccgccacatttgccactgcttatcactgttacaccgtgacccatcccttgtcgactattagatcacgtttcagcttggtcgagattgtgtccgtggcgtttgtgacgttatttttgccgccgaacattgagagctccaagtcaacattttcatccaatactaactttcagagggtaccacttcgttcggtaagaagcacaccaagtcgcacactctctgcacccgatgcggtaagcgatctttccattgccagaagaagacttgcgcctcttgcggatacccctccgccaagatccgatcctacaactggggtcagaaggccaagcgacgacacaccactggtaccggtcgaatgcgatctctcaagctcgttgaccgaaagttccgaaacggtttcggcaacaaggcttccgagtaagttaaccagtaggttgataaaaaattaatgtattgtacatgtggatagaccagcaatgacgtagcacgagatgagtgaatgagctgtaaaatatttaaatttgaagccgatattgacttcagaatcaagcatttacagtaagtagagagaataggctgtgataatttgcacggcagctgcaccgagtggtgcagtggcgacctctgtgctcacgtagaagtaagggtgctaagaacaaacccaggttgcgatattgggtactgtactgttgagtgagtgtggatgattcattgagcattacgttgggatgactagtgtcgagttttgaaagctgagatatcaagtcctgaagtttacaatgtacttatacccatcccttggcgtatggtggcttcagcgctggacaagggaccatagtgatttcccagcaactgcaagtagatgtatagtatgggtgctcacaagatccggatgggacgttggtacgagaacgaatagtggtacgagttcgagaagtagtacaccgctggagtatcactggagtatcactggagtatcacttgagtatgtagagtgagatgatacagaacatctacagtataaagtggtacagtacaactcgagggctgattgaagaggatctgaaattacgccacatatgtgtagtagttcacctcaggaagccatatcacccgtccttcaagtatagcactgtttccgagaatatagtcaaccatgtgaagatgatttttcaatgctcacagatcgaggaagggatgtgaaaattcttgcgatcaccgtggcttgaacatgagttgctgtggattgtatacctgctgctggtgcgtgcaagtgtgatctccatctcttatactctcgcccggttgttgtcaaatgcatgataaattatttataaattagcagcctccctaacgcttcaagccatggcagccaccgtatggagttcaggaatacctatatcctgtaggcgactgagacaagacagaaagagccttcgggttaattttggaatcccgtcatccttcaatagcgataagacccgaatgcaatctttactaagctggggatcgctgtagttgtccagacttctagtcagagtctccacgacttcggaaaacatccacatttcagcgtaggcaggatcggatatgtgagatagcgcaaaatcggtcttccataataaatagaaaagtcgcatcacttttctgcatgccaggatctggaacttgcgaagaggcgccaccagctctccatctagatcgttgagaatcttggaccaaggaataagaggttctgagggcgatctcatcccgtcactgtatcccttgacgttgagatcgaacccaacacagtaaaatcgatcttttggggccgtcaatttggcgctaaagggggtaatcttttgtttggtctctagagactctgtgacttcagggtcgggattaaactcggccacaatggtacataagatgtccatggagtcgcatctgagagtggctatcgacagattattgagaaagacacacatcttaatcaaactggtaacatccttttctctgggactacctcgagtccattgattgtactgtaactcgacgtagtttctcagaaaccgaaccacgtggcatgctgtcgcgtacatattgtagcagatatcggcctggaaattgcttgaagtacggaatgactgctccgcaagagtgctgtcaaaattcatccagtcaggcttgattcctcttcttcgtgcagcagctcttcttgccctggaggacttcttacggcccttctcttcagacacttcaggagtaatgttctgatcaacctgccagagaggccgtgtatcctccaacaggcgacacttgatgacccattcacagagaacagttatatctgcagctggaatcagatgtgttcctggtgccacaatcgaggtatagatgttgtttagtacctccacgttcagattggcttctcgaaggtaatggaagggttgggccatgtcaaaatgattcaaattgttgatattgtctagtagagcgtccttcattgtcttgataaccccatccaaagccttatcgtcttgaagatagaacggcaaagccggtgtttcggccacgatctcgccctggggaatcttttgtttggtataaaagtactcagcaacaatatctgcgtatcgggtactctgaacgtgtttccaggatgcctcgtttgtgcccttgaaaacgacagcctttgaagtcatcttgggtcgtgcctcagtagtcaagacgacatcaatgtcgttgaaatccgtatcaatgtcgtcaatcagatcaatagtctcgttttccatattgcttggcgctcgtttgtgaccattgccattcccctgtctatgagtgtttctcttgtcagccattgtcggtctggctgacttgctgaaccgtggtccgtcaagatcggggaaatcagcctcttcttcctcgttcaggtcaatcgtcgccactttggctgctctcttgggcaacatggcgccccattcgtcagcccccgagattttccgctttcgggggttgtccgattctcgagtcacattggtcacgctgtggtccctggaactgcgtgacctctgagtaccgggcttgtggacactgctcctagactccttgttggtgatctcgagctcctgttgtagaaatgcaaaattggagttctgtctctccacctccagctgtagagccttgaccttctcttccagctctgcagtgaccgatatgtgctgttttttagccattgcaagctcgtggttgtgtcgtgctgttgctgtggccagtttgttctcggccagacgcattagatcctgctgcttggtctgttctcgcttcagctccttgttttctatgtccagctgtttgtacatgatctcggcatctttggggttcaggtccggggccatcatcgtaatgtctgcctggattcgtgtttccgacgcgtccgttcttgcggagtccttgcggacatctctcttggctgtggggatactcctggtatctgctcgagttggtggagcgatgggtttgctcatctgggacgccatggccaagcccgagtcgatttcatcgaaaaagtcgtcgtcaaactcgacgtccagcttggacagctgggcgtttagagacaacggcagcatggcatgtggttggcgtgtggcggtgtcgagtatatccagtggtttgtcaacaaagttgggaggtgtacccaccgcgcatatgcatgttgcacttccgattttgggtgtgaacgtgccaaagcaggatcaggtcgtaaaagtgagtgagtttgggaagtttgacaagtagccgagtacagtatagctgtggttcatctggagatatattatgtcttctttatatcactgttttcccactacaaattattcaaccggggtctgagttgtatgcacctacaccttacaattatgcctgtctcacatggtagattggaacttgtcgttgttgagcggtaagatgttattactgtgataaatgtgcttgtaccttcttgtggatgactacttgcagttggccaagaactacacccttttctcgccgctgtattcttcgtcatcgtcacaacaccccactttcttcatactgtacatctcaaacgtccggtgtcggcatagacaatctaaggcgatgtaggtgctgatggatacaggcagtacaccattcgttctatgacttggttacgaagtacaatactcgtagtggttcctatcccgcttaagatatatctcagtcgaatcaaaagtagttacttcagctactgtgcggacttcctctttgtctaactcgcagtctgggcacaagaccatgtttttagaggttgataaaagctagattgacgtgactcaacagatatgtacccgagaagacgagctatgaggtggggaagttggccgatcgaagtgaaatgtcacttgacaactgatggacaaaaaacggacccaataatcgccccatatcggctctgtatactcaccgtatcgccactcccccacaacctcgggtcccaatcccaacctccatcacggctatcaaaagcttaattgaaaagttgatattttttcagcactatttcgaaaacccagttgaaaagcattttccaaaccccacacactcatacacacgaaaatgaagaaggaggccaagccagtgaagcccaacgacaagcctaacgacttgcaggcgtccaagaaggacaacaagatcgaaaacccctcgttcgtgcccgaacagcccaagcctctgtcatcaaaggacaaggacacaaagcgactcattgtcgttctgtcccaggcctgtctggaaactcacaagatcccttcttctggaggcgacaagtatgcactgctcaactgtgacgaccaccagggtcttctgaagcgaatgcagcgagatatcgctgaggcccggcccgacattacccatcagtgtctgctgactcttctggactctcccatctccaaggctggcaagctacaggtttacatttccaccgcgcgaaacgtgctcatcgaagtgaatccctgtgttcgaatcccccgaactttcaagcgattctccggtctcatggtccagctactgcacgagctgtctatccgatcggtcaactcggaggagaagctgctcaaggtgatcaagaaccctatcaccgaccatctgccccacaagtgccgaaaggtgacactgtcgttcgacgcacctgtggtcaagacccaggactacattgagaagttggatgatgacgagagcatttgtgtgtttgtgggagccatggctcgaggaaaggattcttttgccgacgagtttgtcgacgagaagattggtctgtctaactaccctctttcggcctcggtggcctgctcaaagttctgccatggagctgaggacgcctggggcatccagtaaaaggcgtgtatcgtcatgacacgatattggacaagacttttttttgtattgggaggaacgcatagacatctacgtaccacataaaattagatgatgtatatataatgatggtgtgggtgtggtgacttggtgtatagctgagatcaacctggtattgagtagttaggtacatcactcgatgccggatattgtacgtgtacgagaactgtagtcacgcgggtttgtcttaactagctacaagtagtaggtgcagtctaccggaacgcgccgttggaagtcaccgttgtatagttagtgttgtgatttatagagatacgaagcctgctattgtttcatatactccttgcatcgttcagattgcgaaaatttaccttctatgccttcaagtagttgtgaaatcgtgcacaagtcgcctgttgtatctgcaccagtaacatcgaaccgctcgcgactgactacatactgtacaagtgttccagccgtagcgtctataccgttgaggcctgccttagtgtatgacacttcagcatagtgggataactaccatgaacctgcactgtggacacagtgagattactcgtagtgaattttgcaactgtggctttgttgaagacccgtctgctgtgctctgtgggataaaatgaactgcaggaagcgattctctggctccactactcgcttgagggtgaagtttcggacagactacaagtagcttcagctggtaaggtgatatttctgagacaatggggtagtctggtgtgtctaatgatgtgctcgtactcgtacatagtgtctggtgagcatcgacaccctgtcttgtctttctggtagggatgatcgtgcgaccggttacactcagcttatcttgcgtaggctgctcagatcgaactaccaaagttcgtgtcctcttaatagccccacagggctgtccgccgcatgctgcatccaatcgatcgtgcctgggagagtttgctacatactgtacttgtaccgtgcctcaacggcttcatgtgaagaccaactttgtaggttggtgaaactctgggcgatacgaaatgtggagcgcggaagctttcgtgggctgcgggatttgctggaggtggctcgtattgagcagcgttcttcaatttactggtccgtgtgtagaggatatgagccattttggttattgtatggattttgtgacaacggtgtcaggcgccatgtagagtacgtatgacggcagccgtattcgcttgtgtcgactacatttcttgtatctttgtatgatagtgagtagcttctcgtacagagaattgtgtactgggaagaacgatggtgtaacttgaatactggcatcaaaggtattcacatgttaatctacaccatcattactgtagaacccattgctcttgttgtcgtctcttccctacgagtactacgagtaataaagacaacgacgtaagattcttgctgcgatcgaagagccgtggacctcttctcattatgacgttgacgcgcgactcatcacttgccctaattctgtgcgccgattatgcaaatatcagagggccagacagcaacccttgggatagggctcttcccaaagagactccagtggtcggagacgtggagccaagatttgagccaagcgagcccagctgagacattgggagtctggggtgagacagtgagcctggggacggccaatcagtgctctgtctgtcgcggcgccgcctgtttagctcgatatatttcactttggcgaaattcaattgcaaatccaattgcaggcggtctaccctcaagtcttgggtatcgtactaagtgtcttcttggcaccgtctttgctcagtgtatcggaggtgcagtaacatgggctgtttagatttgtcccctcttctgtgtcattagtgcgcagctacggcgaggctactctgtagcgtcggggctgtgtctggcagggaggcactgtttgcccctgttttgttccgtactacaagtacttgtattaataacactgatattatgtggcctggccgccttcggacaggtcctttttacacacccctatagcttatcgcgtgtccgaaccttttgctgtttgacagacaagtggtgactgaaatgcaagtaagctacaattgttcttgtaacaactgttcttgtttcactcgtttcgtcttgttcatgtcagtagggttaggactatctccgcattggaccctttgggctgttctctgggatagtcgtatctgaaacgcgttctgggtgctctcgtaccgcagcgtacgataccgggctgggtcgagctgtcgagccgtggtacacatgtgcttgtaagagtacgatagctatcttacctgtattggtaccagcatttcactcgtacgtacgatactgtagcagttgccccatacaggcacgtcatgtctccatattacatagtatgcctgtcatctgcgatcgtcgcattcgaccactcgcattgtcacacccctactgcagcggcgaagtgcaatacggacacataggtggtggtgtacgataccaaggatagacattgcaggatcgcctgtcgcctggaccgcaaagtctgtctccgctctgttcctgtcttttcatgttttagtgcgtcccaatgctccgtcctttttccccatgtttatcggacaacggaccttgtagcttgctatgtacgctccgtagtgcgagaaagtctttttcagaaaataggctcagcctttgtgttcggttacagtgtgagtcagtgggtggcaaaatggataaacaaccgacaggcgcggaccaggggtcgtggcattttcctcgtgggaaacgacgagttttcgagtatatggatgtgttgcgtgccggcgctgttagatggccaccgcgccgttactcgtgttcgatattatatgccgcattcacctccattttctgccgctttttacactgtggagtgggctgtatggtatacacaccccatgtagcaaacatataacagcctcaacgttcgaacgtctcgctttggtcggtcagggccagagctctcgtatcggtgtccgagaaaaccaaattcactgcagaatggcgaccgtcacctgctcagactgccagcacacccaattctatactgtatctccctaatattggagtgggaagcgatttgtgggcctccccctaacgcgtctcgatatcaccgcaccgcaaattctgcatgtctgaagcctttgaccaccgcctccctgacaacgccactgtcacgtcccacaccagtcggctcattttttcgactcccttccatgcactcctttgttttttcctttgtctcaggccgcttgtcttgcataatttagagttgtgcagcaacagccgggtaaaatgcccaatttagcgacgtgcattcaatccctggctggtgcactctcttctatttcaaaggcctctcttccttcccttcttctttttttgaattcgaaaattttcctttcacccaaccaccccctacacaccccaaaactgtctgtctagcacgacaacaacgctctcaacaggacgcgaaatacatattcgaaacatcgatttgtttgacgcgactatctcgttgaggattactggtaattaattttatccgtggtcttatttattgagctcttttttatcttctacacgccactgactccttcgctggtagcttggtgcgcaccaacccgtctaatttttgctgacgtgtctttttttgaaaccccccatacccataccctgagcttaactgccccattgggacattgacaaagcttatctcaacatggcctgtcctcttacacccccctatgtcttcaactcggcatgttccgacgatgacaagatccagctgaagcgacgaggtgactttgccgacaaggtcttcttgaagaagttcaaggttcttccttctgctgactcctccgagtccgagtcctgctccgagaccgaaatccgacccgtctctcagcgacagcggtctgtttcggccaccaagctgcgacgacgacggtccttcgctcctagctctgatgtccaggctcgacagcgatgcctcgagtatctcgtgtctgctatcgacgaggtctgggctcgattctgcgcctgcacctcgtttgctgaggatcagcactacgcttacgacatgcctagccccaagcaggatgtcgacgaggatgacgaggagattgaagacagtggaaagctgcaggctctcaaggaacgtctgaccaaggccaagtactaccttcaagatctttctgatgtgtccgacatggacgcttcggtgtccttctggaaccgatgggatctggtcaaatacgctgttatcgagttcgtcgaagacaatggcgaagaggatgacgttatcgagggagtttgctccgagctcgaggaaggtcgtctgtgatcacccaaaaacaaaatgagaatagcgaaagctgcagcacgtgactgtctaaacacgcgggaaacacctacaaaaacacaaaaaaaaattacaaaagattgcgcaaagcaacaacaaataacggaaattggggaatgatatgatatataggatacggcgttatgcatggaaatagaaatggattgatgtactatgacttttgactgtagcaatgttgtgagacttgtacttgtagattcgatagaacagcatcgtatggtgtttcgtgttcttcggcaggttactgttgtcatcatatatcgtaggtaatgacgtcaaaataatcacagacgctgcatgagggcggcataagttcggagatctgacaacggcccaaggtcaaagtgtgataaattaattaatgaaaaaaacattaggcgaacgcatggaaatagaacaggtgtttggatgcatataattcggcacgacatggcgtatatccaatactcagagagacagaaagactttagagagaatatagaaactagaaactagagtgaacacagaaagactttagacagaactcagggaaagacgaaatgatattattgatgtattattattcttattacatactattacacgtacaggtagcaggaccatcatagcagacgaaggcatagcagtcgaaggcatagcagtcgatggcagcagtcatctcatctcaggaaagccttcatttcagcaaagcatgcattcccttagagcccgtactgaccgttctcccctcctctgttgtagcatccctgtgcctgttgtctcccactctccattgctcatgttatccacaactccttaataaatggttcgacccttctcaagggcatcagcggtggccattttctggttgaagtcatctgagtgccgagtgactccctcgttgatctccacaacctgcttcttgatcttgtcccagtaatcccagaacttttgtgacgccttgtaggtgtagttcttgtaggtgtaccgtcccttggagggctggacaatgccgccggtgttgctgagaattgtgagggtgtttttgagctcgttcagagtgttatcgggtacggctccgggctccgtcttcttgttggacagctcgacctcctcgctcttgatgagctccttgagcttctccacggcgtcctccaggtacacggtgcatcttctctgggcatcgacgtcgctcagcggtaccagacccacgttgtgcagtcccgcagtgtagagatcccctagagcttccattgtgtcttgttaggagtttgtaattgtgtaagtagtcggttgatcgagttttaggtgtcgtgtgtcgtgcacgtagaacggtgaacagcgtctcgtgtgtgagtgtgtaagggcggaaatgtgaaactgcagtagagtgagagtgagtgttcctgaatccttgttaggagatgcgccgcaagacctatgtacacgctctctcgattgggattttgagttaaagtggaaaggtcagccagcctgcctgataatttaatgggggctgagcatggacagaaggtgtgagtgaataccgagagactagagctgatgcaaaactatgccagcatgtgaaactattgagacggccccctggggcgttgaatccgtccatggatcactgtcaacgtcatatgtgtcgtatttatgtcattttacggttattccggctcagcatttccggccaggtgcatccctgccgtcctcatacatactgcaaatcctgcgctttgaaaataaaatacgagctcggactccggcagagatgctcttcgccttatagtgcacgcaactggctgggaaatgaaatggaggctgagcacccgagtgtatcggcagtagcgttatgttcggcaacggtcaaaacttttttagctgttctgagaataatacgggctagatatgcgaagaagccacagtgggatgctaaacaagccgggaagagctccaagaggatccactaatcacttcaatatcaattcagcccctgctgacggtgctaagacccatgccaagcttcatgtaggttccgataggcttggatcagaaatgtccatgaactatgcttgaactatcttagactaagtcatctccggactaccatctttaacagcctgtgctaacggggggggggggggggggggggggtacagaggcagttccgaggagctgctgatgccggggtttctttttattggtttttgtccgtgtaccggtgtttctagtttctctacaacaggtggtggagtgtaaatatcgtacgtagacaatgtctgatgagaataggagcaactcgtatgtgagtgacgagaagattgattgtcacaagccacaggtacatactataccagcatttcactcagtaaaccatcacgcacctttaacgacagtggggttgttactcacaaagagttgacctcttcaaaaaggagatcacatggcttactatgacaatgaagtatgtacagtatatactgttgcttgtgttacttgtgctctttaccccctctcaacaacaagcccacgagccgcaatagacgggtccctcggaacttgctcgccgtctttggtttaacacattgtcattgtttgacaatgaagtgggtcacattatccctcaaccgaatctaaattgggcttgtcggataagtgacactacctacaatgcaactagctagcatgtgtatcatacttcatactacaataggttaggagctttgtgaatgaaacaaggctgctacttgtagggaggcacatatcgcgagatggcactagcgaacggggaggacgatcagctgccaataaactgtcaagtacatgtgattgtcctgtcaggtatcgtctgcgcataatccatgcatccaaacttcttttttttcaggaaatgtcggagagcaatgcaacagaggcatagctggcaggtataaccagatgtacgaatgtgacgttacacgtaggggatattattaaaaaacggcgcttgtttgtttggccagctaactggatacggtggatttggcgccgttgccataaccactgtctgatacacacgacaagagcacttaaggtaacaatgtgcactcgtgcgagacaaatacaatgccattttcaagccacgcccagaacgcatgtcgaatgaatcatcttgctgttttccatgttaggttggttgctacagttgttccgagaggacgtcagtgagtgcggtgatgggtagcagctacaggtctcctttgagactgtagaaccaatacaatatgtagagcagcctcacaataagccccctggaaaagtccgactctcctgtcatccctacaagtatagttctcttctattgattacttttgcacgttggtcgcgtctttagctcggctcacgttccatcgtctcgataacgatagagtttgacctccaaggtcacatatttagtgatggcagtccgcttcctaccgttacacaaagccccttttgttgttttatcatcaagagattttctatttatttccgcccatgctccacctactgcctccggaagttctggaaaatgtgctcggcaacctggagacgctaaatgatctcctagcactgtcccacacctgccactttgccagatcagtggtgttacacaacgaccagcgattcaaaccacatgtgcagcatttgtgtcagtacatgaccccagtctcgtcatggcactccagcttgctcaggttgccacgcaacgcaaacaacctcggtactccagtagacgacacctggaccatgtccccagcagtgtttgcaacagagccgaccaaagacctgctgagactccctcacgaaagattacagactcatttcaacagatcaccgcaacaaatcacccatctctttcatgatgtgagacacagatcattgtatggacctattccagacagccaagacacgctgtttgagcttcgatctggcgtgggaccggttacccgaatcaacatgtccaccatgtccagatcaaaggcgcctccacactcgtgtctgcaccatcttgatacaaaagtcgccatcatcgaaaagttcccccagctaaacagactcaaccacatgaacaaacgggtggtcactggctcaagacaacatctgcgaaatgtgactactgaggttttagtaatcgataatgacggagaagccgtgcctctggctactttcacagacaccatttcgtgcagaggagagcctcatggttctctttgtctttctgtggcggtttgtggaacttatgttgcgtgcattgtaggctactccctgttcctgttcacaaagagagacgatcagctgtacttggctgattcgtataagttggacgcgctttactctcccgtgtctgattcacacaaccaggagtgcctgttgttacagcggagtcgaagcagtggccccggacatgatattctgttcaatatcagctccaagacggtatctgtggtagagggtggtatctatgccatcagcatagatacgaatgtctggcgctttgacgacgcctttctccagcagtgttcagtgtctccacaagaagagatgcactggacttcggctgaggttatgtgtggttgagcggacgacggaagtgccttttctcctttacttagtacatacagtagccacttctgctgtctgtagtgatagtggcttggaatgtgggatgtgacccatgagtatttgggaacgtctgttatgggtttttcaccagttataagtgaaaatgctataactacttcgtactataagtacgattcaagtacggtacccgtacgagtacagtattttacagttgtaccgtatgtaccgatacaacatagaccatagattaatggcatgcaatgagacacaacacaaactgtatctacacagcagtagtttcagatattcggatggagcggaaaaggcggacttattgtgccactgacagtactccgaaaagccacagttcggctatgggaacccagctcggcttggttgcaatcaaaatgcttgttagccgcataagtctgacacattgactttgtgggacgcatggatgatgaaatacgagatgctactgtaaattaaggctcgactccctctgtgcaagatcgccaactgagtacggaggacagattcgtaagtgatccggtggaccaaaacgacgcccaaaaagtgcaactgcccgtaaatgttgccgtacagtctatggagagatgcaagtcagctccgtggagctcccatgcatgactcagaatgctgctgtcatgctccccgccatcacatcaagtcacgtgtgcttcaatttaggcgcaagcccaaagatgggaccagatctatttaatcaaaccgcgtggcgcctgtcatcgacgatacaacgatggaatccctacctattatcgacctggctctggcccaggaccctgcaacaaagcctcagctgctagaggatctcaagaatgctcttttccgaatcggctttctctacctcgtgaatcatggtgtggagaaggaggctcgagctcttcagaagttctcgcccaaggcttttaccgatctgtcccaccaggagaaggagagcattgcgatgctcaacaacccccacttcattggatacacagctctcggcagtgaaactactgctgccaaaacagatcagcgagaacagtttgacttcggatcatacggcaaggagagctcctggaaggaaggtgacgagccctacaagcggctggacggacccaatcgattcccagagggcaaaactggtgaggaaatgaaacaggcagtcacagcatacctcgacgccatgaaggagatgaacttcaagtttctgcagctcgtggccgagtgtctcaatttgcccaagaactcggtgacggacttcctaggcgagatggaccgtctcaagctgatcagataccctcctggagatggccagggagtcggtccccataaagactcgtccggcatgtttacatatgttctgcaagaccagacaggaggcctgcaggtcctcaactcggagggaaagtggatcgatgccactcctatccaggactcgctcgtgtgcaacattgcacagggatttgaggctctcactgacggacactgtggagctaccactcaccaggtacagagccagcccaaggaacgacactccattgcatatttttgtggagtgcgtctggatctcactcgtgaggctgtccaggagcagtgtcggttcatcaaggacaagatcccatctcctcaagacgccagaaagcgggaggtggacgtggcgtccgaattcatcagcgagaagtactcttgcttcggagaagcccatctgcggaaccggattgtgtcccatagagatgtggggaagaagtggtacccggacctttacgacaagtacatttccgattattaaggcaagggctggtttggcggttactatcacctgctctgagtgacttgttgatcatggaatgtgtccctctgctaatcttttaaaactgcataaactcagagagattatatttctcggacatagtgtgctcactcctcgggcattaaattattactagtactttttatccaatcttttgattgtgtacgtggatctgtagctacagcatgtacttgtagctacattttcctgagcttctggaaatgcgtgcatttggtgtatagtgctgtttttgatgctcctcttccccacattgtgtgcattctgattcgcttcaaccttagaacaagagtgaagaccgtgtcgggtaaataattgcacattcggctgtggggaaaaaaacaaaatgtaaagactcttaatatgaacactcgagttggtggcatgttctagacggcattgttggctaaggtacgaccgggtctagcgcattcactttcttagattatttaacaccatgcgcattaatggcagggtgcatgacaatgttcctaccagctctttaggctgttgtaatttatcaatgaaaaaaagcgttatgagcaacaggacggggtagctacttgtacctgagctcagtagtacaagaaaagatacgcacgtgccagagctgaaacataccggtatttacgctctcgtctggttctttcatacagcagagtggcttgtttgagataaaggtctcactcacttctgcctttggtattatgtgtgcggctgcatctgggtgtcctgacaccttgataccatacatgtcacatgtccagctgtaagggaaaacctgccaagacagagtatcgtgagaaactgctgagcgatattatatatcaaatctcgtactgtagagagaaccaactttggctacaaaaactcttcttcccacctacagtagcagcgccgtacattagagccttcttccgaatcttatcaccattaacggctactgtacagtaactccctctctttcgcaccttgtaaaaatatcttaacttctcccaacaacggtacaagtagatggaactcacacatgtcggacttcaaaagtgacctgaaacgaggacagagccgcaaaaagcgagagaccctgtcgtgcaacccctgccgcaagcggaaacgaaagtgcgaccatggaaccccctgctccaactgcgtcaagctcaacattgaagccacctgcgaatacggcagtaactctcgatgggaggagagcaaggataaggaggtcaagtcgccggcctttatcacccaaacaagccttgactttctctcaaatgcctcctctgtctcggagatcatccacctgtttgaaaaacacctgccgatccaaacagcgccaaacaacaatcccctcagcatcttttcctacaaaacagaagagtacgagagcgccattgccaacgagccgctcccgaagaacataagcgacattctgatcgagaactataggaatttggtggaccccttcttccccattattgactggaaggagttcgaagaacattatgaaaacctataccccgggcaggctggtcctacaccgccatcaccgccacaaccaccgtccttcctggctctgatatacacagtctacgccctgagttgcaagtcctgcgctttcgactcgctgctacataccttgcatgcttcagccgtcatccacttttctgatcgcgccgagcaatacctcaacagaatacccttgttagtgacctcgtcgatcgacgacttccgagcagcactgctctacatttacagttcattctctggcgactgtcttatggtgggatggtctctgtgtggtctgttggtaacaatgagccaacggattctgcctccctttacagcctccagcgacgtgaaggaagctgcaaaccacctcatttcggtttctggcacttttttcgacgcctgccaagcatttgtaggccacaaatctgggttagaatacccccaattgcctttcagctcatacccgtttctacacactacccagaagctctacatgttcacccgtggactgcagaacagccatgattcttcagatcctgctgaactcctgcgaatcgaccagataatcaatactcttccccagggagatcctatggagttcatgaagaaactggcactgacaacacaatggcacaaggccaatcttttgcttttccgatgtggcaagatcgaccgactctctggactcatgtcacttctgaagctactggagaaccaattctatctctactctgctcctccacagatccaacaatacattctgtttcactggaacaacatttactaccatgtgttcacgggagtgattgttttggctctagaactggaggcaactgatcctctgcctccgctggatccatctgtattccccaacctctccaagctcaacctggaagaggacaagaactggaagtccactctgttggctgtcttgcgtgatcagtactttgatctcagagtcaattctgagtgtgctagtgcacgtgctcacatgataacttcggcatttctggcccaagacacacatatggagtgtccacgaccgtttggacctttccataagatgctgtgcctgccatcaggattttacatctgtcggtttgaccggtcgtactttcagtgtggctacggaatggagctggaccgtcagattggtcgtgcgttatacgactccaaggagagttccaaggtgtttctatagcttcttcccagagatgagaagacatctgtatttattgcatttttcaatgccagtgtctgaactgtagttcaagtaagttactaagtaatactaagtaatacgcgaagataaacgcatgcaaaacctacaacaagcaggccattagccatcacgaaagattataagaagctgtttgcctttcaatatcaacctccccccagttaatcccacttagtgacaacccctttcaccataacataaagctacttgtagttatgttcgacagtggatatctccaaatccacctccgcaaataaagttcaaggtgcatgcacaacagaaaaaattggaaaccatctgcaagatttcaatatcaccaccaccacacaagcaaatcaacaatgtccgcccccttgaaccggttgacgattgctaaggaggtcaaaaagggctccgacttgacgcccgagcaaaaattctggaaaacctaccgttcgcctctgctcgtcaaagagtacaatgccatctctcacgtttccttcaaccatcacaatgactttgccgtcacctcgtctactcgaatccagatcttctctggaaagacccgaaaagtcaccaagactatctctcgtttcaaggatactgtatactgcggcgagttccggtctgatggtaagctgattgtggccggtgatgctacaggtctggttcagatcttcgatgccgtgtcgagaaacattctggtgactctgcaggcgtcccaactggccactcatgtgactaagttccaccccacaaacctcaccactctcctcacagcctccgacgaccgaagcgtcaagctctacgatatcaccagctccactcctctgatcgagtttgagggcgctcaggattacgttcgatgtggagagtttgtcgatgccaacgttgtcgctgctggttcgtacgacggaactgttcgactctacgacgcccgatccggaaagacccccatctcttctctggctcaggatcacccggttgaggatgtcctctaccacaacggaatggtgttgtctgccggaggtcccattgtcaaggcctgggacatgaccaccggaaagaccatccgacaaatgggcaacttcagcaagaccgttacttgcctggcccctactcacggtgcttctggattcttcgctggctccctagacggccatgtcaaggtctttgatgatacctcattcaaggttacctacggctggaagtacggctccggagtgctctgtactggtatgtctctagactcccagcatattgtggccggtctggtttccggtattgtcgctgttcgaacccagcagcccaagaaggacgagaagatcagcaacggacgggttctggaccagaaggctgctgttgaggaggagaagaagaagaaggcagagggacccgtgcttggaggaaccaagtacgagggtcagtttgagcatgtcattgtcgaggagcacgagcggcccaacaagaagctgctgaagcgatatgaaaacctgcttctcggattccgatggggtgatgctctcgatgctgcactgtctggagagcatctggagacctctgttctggctctggaagagctcaagaagcgaggtaaggtgcgagctgcactgctgaaccgagatgaggactctctggagcctctctttgagttcgctaccaaggccattgctgactcgcgatacatcaacattgttgctgactacgttgcagtcgtgctggacatgtacactagtgtgattaccaagagcccgatactcgaagagcgggtgtctgagttctacgacgctctcaagtccgaggtcgagactgctaaggagagcaagaagatccagggtatgttggagctcctcagtgtttagagagagcaaaaggatggatgcatttgttgaatagatattagataatgattgggaaaatggtacttgtagttatatcgctgcttgtagactagtatgtaagtagttgtacatggcagctagtcaaaaaacactgtatatgttatatctctaaatgcgttcgtatgcttatgttaaatgctagggcgatcacttcttaaacctcgaggcccactgcttctgtcccatattgaccttgaatcccgtgttgagtctgttggtggtggagaagttgtcgttatccaccttggccttcttgtgctgttcagactcgactcgcacaatagcctttttagtggttcgcttctgcgtctgatgcttgcgtttcttgataccaccttctttgtagataggagcactgagagcagtctctccttcaagagcagtttcatgaacccaatctaaatcgtcctgcacaggttcatcataaggattatggacctccacagttcccatgatctcgtccagctcatcaggttcctccccgtcgaatgtaacatcaacgatcttaggctctttgggcttaggaggcagtccttcaagttcacgccaagcgtcttcatcgtcatcatactcttcagtctggttagctggtgacaactccttctcaggagacatttgtttgataggactctcgactacagactgcctgattctctcggcgaaagagagccgtttttcgaatggagaaacatcaacagaaatgcggttgagatatgcaggtgtggtgaactcgtcgttgacatccaatgctggtttgttggtcggcgtctcggaggtgatggaaacaaccttcactggggtagaaacgttaccgggggtggcaaattccttcacgggtgtgccatcaagtccttccagcaaacttactactcttccatgaatgctaggtgtaggtcctaacggcacgctcggggatggtttgggtgtcgcagctttaggagtatcctgtagctgtttctgaggtgttctggacagtgctggggccttagagaaggtcaatgaccggtgcgagggtgtgacaatgtcggcatgctgctgtttggaaacagatcttcgtctgttcttggaaatctgtttttctggagtcttgactgaaaacgacacaggtttgtagttcaacgacgagtgtaatttggaagcccgtttaggggtggaaggaccggtgccagcactttcagcctttttgaacttattgtaaagatggtactttttcgctgtgttaattgttgcacgaagagcagtgccacccccttctctgatactcaccaatagggtccgccttgacctctttaggcgtaggcttgcggccgtgtttatcagcgtatgctctttcccatgccttgatctctgatcggagtgtctgaatgtccattgtgcccagctacaccgtctgtagcagtgtggagtgtgttttgtagtgtgcagaacgcgttgctcgtgtgtaatattaatttagacgcgcgtcgtcacgcatgaagattggaaaaagttggaggtagtgaggtgaatgcgtactcgtagacatcatgagccatgtcacaggactggcaattttgagagaggatctctcatgacaacccacagctgagacaggtctccaaactgctagcatcattatctacaatgactattagaggaactctatctttgccaagtatatcaagtactggtatgagtatattgagggctggtctttacaggttatgagaattaattgtgtgtgcggtaatatttacacctaaaagaagtacacgatagtttaatttaagtgattcacagcttccaacacttgcgagcaacttcgtagaaatacttgtacttgtagtgtgtgagtctttcctgagtccccgcctcctcgtgtgagctgtaactatcataccctaaccctacacactcagtttgcaggtggtcaaaatctgattcactcagaacgcagacaccatgattcgagtgtttttgcgccagggacgtgtattgcgaccttcaacgctccagtatcgactgagacatttcagtgacgacaaaaaaccgactcaagggcttgattttagagcgctgaacaatgaaatcggaggtgagcgacaagacaaaagctctgttgagaacgacaacacgcctgtgagccaagctatcaacggggacattattggagcctcttctacaagctccgaaaccccttccaagccgtggtatctgcgagatcaaccggaagtaaaggaggagcctgtcaacattgacctgggtctgccagatggagctatgaatgatatcgccaagcagcttgcacgtgatgccatttatgacatcaagtacattcccgagcaggatattctcattgggtccggcaagtccagtcgacacatctacaaggctggacgggaagttatgggagtgctgaaacaccagcatgatgttcttccaactgctgagggactgttcaagaagaatgcacagagaatgtcttaccgacgaatgctaaagaaggcccgaaagcagaatctcgagttccccgactcggaatgggtcgtgatcgactcccagatgggcttccatgtacatattttcactgccgagaaacgcgagcttgtcaacctggaggatctttacaagtttgagatggatgaagaggaggttgaaatttcgccagaggactttgcttgggccgaaaaaggtcagaagaacgtcattgatggagatgaattcttatctggacagcacaactctgatcctttcctcaggagcgattcgatcaccggcttgcccaagaagccctctaacaacccctttgacggtggtattggaagtggccagagaagaagtctccatacctcagcaccagctgcaaccacccttgcagtagactttgatggcggatctgcagcagccaaggacgacgagtccaagtcccacccctccatcatccctctcttcatgtaccaaaagtgggccactcagggtgacaaggatcaggttctggcaaagtacgacgaccttcaaccgcatgcaaaccgtaaggagattgttctttctgccatcaccaactttctgaaacttcccacaacgggcttcaacgacgttccgcaagctgtagaggagctttttgaggtcttctccccttcggatgcatccaaccccgaatggaaagaggccttcaaggctctggttaacgcctacgctctgaaccacaagtgcgtccctacacaagctctcgtcgactaccttgttgcccagcaggcctctggagccgccgtggtcaactggcaagtctccgagatcgtcagagccaccatcgactccacacaatacgagcaggttggcgtgacttctctcaaggagtggcagcgagttgtggatgccaaaattcaaatcatcaaacagctgatcgagagctttggactcgtggctcctgtgagattgcttgctaacgacagattcatccgacgtgtggctcggtctcttacccaaagaacctctgcatctttcggtctggaccttgttgccaagcccgaaaccacaaagcatcccctcgatctgcgtctcaagctattggaagagagtcttcccatcaagatgctcaacagaaagactctgtttgtctttttcgcagcctacgcaaactcgtacgcctggaacccttttttcaagctcctgaagcgatgtcacaaggaaaccaagactgataacgcccacgttcagacgatcatatcgctggttctcaactctcgagacgagactgcctactaccgactgatggagtccgaactcggtcttctctgcgatgctcagggagagttgcctctcgacaaggacattgctgtgaagctcgaaaagttgatggacaacattgatcccgaaggtcgtcgattccagcagttgcggcacaagaccaacacgcagctttactcatgagtaatgatttctcgaatggtatataaataatgacagttacggagtttatgcgaagtcccggtacagtaggttactcgtacttgtagttacagaatgtattgtattagttgtgtgagaacagtctgcagataggagaaaagacataggagaaatagaagtagaagtaatgtcacgtgacttccaatcacatatacggacatagcagatgcgacatcgctaaggtgttcatgtcacatgaaaccgtaccactacagacttgccctctcatctacttgtacttccacctgcttgcacaatggaagcttagattagctcaggtttttgctgttttcggccaattcaacccaaaaaggaaagtggaagtctgcaactgagccaggtatacagcaccgagagggcgtcaagactaaagataaataaccgacccagaaggtgttccgagtcttccccctctgtctccaatcttcgcctgttcctgcgtggctgcatttatgcattctttttcacagtccaaacaatctccaccctcaactctaagtttaggctttgcattgttgaccaaggacggctgaaacataattctcgttcctgaaaatacagtcggccaccacctccatctgtaccagtcccacggtgcccacgcgcgcagagaatcatgtccgcccagaccgaacgccgaattattggtgatggtgagtaaacgactcgcgagacagaggagcggctatacagaaggatcgtgtaacagaggatgctaccttgacactaccatatcgacaatatcagaaagtgtttcaacgactggctcaacctctcaactccacctaacacagactacaaccacgccacggatggcgagtacaagaagctccgtgacatggctcacaaggagtacgagcgacgaaaggagctgtcacagaagagtcagcaggcctacaagagcggagacggcgctggagccaagcagctgagtgaggaggcaaagaagcacggtgaaaagatggaccaatacaaccgacaggctgccgagtacgttttccgagaaaacaacacagactccgcccacgacgagatcgatctccacggtctgtatgtggaagaagccgaggagtttctgggacagagaatccaggcagccatgcagagaggtgatcctgttgtcaaggccattgtaggaaagggtcttcattcttctggaggagtggctaagattaagcctgccgttgagaagctgtgcaacgagcaccgactgcgtcatcacatcgaccccaagaacgcgggagtcatgataattgagctgcccaatggaccccagcagcctggacaagtgtaccagcagcccggacctcagcagcagcctcattaccagcagcagcagcaccagggcaactaccagggcaaccagtaccaccagcagcagcagcagggccagggaaagaacgacaaccttcttgtcaacattctttgtttctgtattaacaagtttttgaagtagaagggatgataaggggaaaccggacatttggaggataggatcatagaataatgcaattgtgtaacatataatcatatcatgagtacattttcctttgcttgagaattgaaataatatcagtaggccttggatctctagggaatggacattttcaagtcttacaacatacactcataacctgttttttatcgcgtttttcagatagtagatgccacgttcataaaaaacctaaataggcgccatcatagtatagtggttagtacaccacgttgtggccgtggaaacctcagttcgattctgggtgatggcattattttttgtttgtgtggacttgaacttggtacaatattatccattgggccaagttgtttttgagaccaaccgcttgaactcctaattatccacatttttgactatgtacacttctattttaacattatacagttagttctttttataagcccgcggctccgtttatcctactctgtatcagttgtctattcatcaaagttcttctcaaggaactcaatgaacagcggaatgattctgtcatcgccgagtgctctcatcttattgagagtcacaaactgacgcctcatacgttgcagttcaggaagactgacagcatctataggcagctgaagactgtgattaccaccatctagcttcacgagacctccaacattgtctctttggatatcaaggatctcgctgacaatggtctgggtcttcttatcaagctcatagaggtagtcagtagacgtggcaggctttagcacagttgcctggttgggttttagaacctttcggtgaaccaaagcattccacatttcctcaccagagatgtctttgtcaatatgaggaatggtaaagagaggagaatcccacttgttcgctccattcggctcttcatatctgaatactagggcgtcaaagagatcgtcctcccacttgttggggtgaattgaattgtattccttgcaaacatcaacgggagcacccacatgtgccactccatagttggtagccacggcctttgcttcacaccacagctggtatctgaatcctttgatatatgtcatgttgtcgagaatgacgatggtgtttttggaaaccaaccgtttaacagcagatatttgctcgccacgggtcattttttcagtccggctctccttgtacgagtctttgctcagtcccagagactcatcattgatcacctccactgtcagattcgaccctgtctcctggatcttcttctcgaagtagtcctttatttgcatggctcgggttgtcttacccgcggaagggtatcctgtgatcaagagaagaggcatgtcgcaagttgacgtgtgtgataattgtgtggagaagtgtgtgtgagagaagatgctcttgagcatttgattttttagagttcctttccactgattgatgtgaaatggggaggcgttatattgggcctagtaatcgatgatttgagtcaaatttcgagttaagaaactaaagcagaaaacaaatactactttaatattgtcttctttctttcaaaatctctataaaatctgttatgtgcacattttgtcatctctccgatatactgtacaagctcttcgccaactttaatgaattttatgtgcatctgatgcagactttcaagcatcggtgtacgccactaccacattacacatatcaccatgagggaataccaagtcaatatggctgcgagtatttgccgttgcggcgcggaattactcaccagaagaggcatccgaatgctatctacctcgacagtggctacacagagcagatcaggaagcccaacagacacccaaaagcgaccaaacaagatatcgcaagagaaacaggacaaacccaagtcgctatttgtccctagaacatctttcgacccagttcaagtttcaacttcaaactttacacatttccacaaagagttcctcaagaagggcatgtccatgcatcctcatctcactctggagttgagagacgctagggcaccactgagcacaggaaacgtgctcctttccaactcgttttcgtcagcaattggatcaaacagactctatctgtattccaagagtgacgcctcccttctggatgatgagactctcaaacaatggcaccctcagggcaattatctccagattgattgccgatctagacaagcagcagtcaaaatcatgaagtacgcagccacagtgttccagaaaatcgaccctccaccgccagtggggttcaatatgttgatttgtggcatgcctaatgtgggaaagagtactctggtgaacactatgagacggttggtggtagaaaagacaaatgattggaagatgcaggggaagaagcgatctgtggcccccgttggacagcaggcgggcgtcaccagagctctgtctaaccgaatcaaggtatgcgacagccctaacatctttgtgtttgattccccaggtctgttcatgccaagtattgccaacagtgagactatgatcaagctcgcccttctcaagtgcatcaaggagagtcttgttgatcctatcgttcaggctgactacctcttgtacgcactcaacagagatgatcccaagagttaccgtgatctgtgtcctcccaccaacgatatcaacgatattcttgttgcactgcggcgcaagtggcggtcaactcctaaccaggacgctggaactgctctgcggtggatcaacgagtgggtcagcggaaaaaaaggtaaggtcatgctcgacgcagctactcctgaggcgtttgacacgtacaatcagaaggaaagtgaacgaatgcgagcgtggatggtcaagttccaacaacgaggcaaggagaagggtggaaaccgagccagtaaaatcttccgcgcataaaggtcctacagactacttaaaaccaaagtgtatatagtaccataagtaattattatttgtatatatattaacatggatgcttgggtgtgcttttccgacactgtataaatatggggtgggttgactgtgttgagacgcgtaatagctttagttactcctcatactcagactccatcatcttttcctctgcctggccagcctgaaacgtctcattttcgaaagcggcatgtgctgacatgaatctcgtggttagcattggcttgtgggctccttcatatgtctcaaatactcacattgacgcgtgaagaatgccgagttctctgatgtgcaatgcttgttctgtggtccgttccatgaggttgctcatgtcaaccagattagcctcaagctgcgcgagctgcgacttgagctgggtcatttgacggtctcttgttgtcatggctgaagttgtgtgcgaggcgtgtttgaaggcgagtctcagaatgtttaaaacggtgtttagatgaacgttcatgcatgaatgctgcatagtggaggccatacgaacagagagagtagttgaggtgatctgtcaccaaatcctgtcaaatggtaatcacgggccgaaaattataaagtgtaccggactagaaactccctcaaccactcccgtgacctcaaccataccaatagatcctcgttcaacgtaccttatcgaactgtaatcaagggtaagggtaacataactacagcaacaatgcgtggcaaatgtgtggggatccttgtcaaccgtctaaaccgtcttcgacatttcacaatcatctctagcagctcttgtcacactcttcgaaagacaaagctgatctagggacattcaaacataaagtgctttccaacttccatcccaaaatgagcctccagcagttgggctatactcctcgaggcaacaagacgttccagacccaggcagaggtcaatgaataccttgacaaccacgccgcttcttctctggtaaagattgagggtctcgacggtctgtacattgtcgatgacaacaatactgtccatggctctcttggactcaacctggccaaagagtatgctggagccaagtttgagctcaagtccagtcctatcattgagaagtcttccgatctcgggcttgatactcctcttgattaggggattgtgtggtgccacagctaactatatgacgactagcgaagcatactacagtatgtacacctacgatcaatggtgatttgagtcctacacaactgagtaggacacttgtacgttttatatagattcgaatctcaatattttgaattggactgttattcactaataggcgagttttgttcgtaatgctatgagtactgtagtgctgcatgtacattgccaccatacaacacatgttatgagcagataaggttacagttttacagttcgaaatttttctcgatattgcatgaaaggcgtaaaaaattggaacacactcctaattgcacaatcatgggtctgaccaagaaggaaaaagtcgaaaagaaagcccgaagcgtggtgaagggcaaggccgataagaaggccaaggtcgagaagccctcgtccaagcccgccaagtccgccaagccctccaagtccaaggacgaggttgatgagctcgatgatgagttcgatgaggttgagggtctccttgagaagggagacgttgaggaggaagacgaggaggagaccaacggaaatgaggactccgagatgagcgatgacgatgaaaaggacgtcgaaatcgaggaggaagatgacggagagggctctgatctcgaggaagaggagtccactgccgttgtcactactgcgcccgctgacgctgaggttgtccacattgcctcagacgccgagcgaaagccattcagcacaattcctctgtctgagaacaccatgcagagtctgaaggacatgggatttgagaccatgactccagtccaggagaagaccatccctcctctgcttgctggccgagatgttttgggagctgccaagaccggatccggtaagactctggcattcctgattcccgccatcgagatgctgcggaaactcaagttcaagcctcgaaacggtactggtgtgattgtggtgtctcccacccgagagctggccctccagatctacggagtggctcgagatctcatggctaaccactcccagacccttggcattgtgattggtggaaataaccgacgacaggaggaagagaagctcaacaagggagtcaacctgctggtgtgtacccccggtcgacttctcgatcatctgcagaactcccagggctttgtcttcaagaacctcaaggctcttattatcgatgaggccgaccgaattctcgagatcggtttcgagcaagaaatgaaggagattatcaagattctccccaaggagcgacagtccatgctcttctcagccacacagaccaccaaggtcgaggatctggcccgaatttcgctcaagaagggtcccctctaccttaacgtcgacgaacacaacgtcagctccaccgccgagggtctcgagcagggctacgttgtgtgcgattctgacaagcggttcctgctgctgttctccttcctgaagcgaaacgcaggcaagaagatcattgtcttcctttcgtcttgtaactcggtcaagttctacggagagctgctcaactacatcgatctgcccgttctcgatctgcacggcaagcagaagcagcagaaacgaaccaacactttcttcgagttcattaacgccaagcagggagttctaatctgcactgatgtggctgcacgaggtctggatattcccaaggttgactggattatccagttcgatcctccggatgatccccgagactacattcaccgagtcggacgaactgcccgaggttctgcctccggaaagtccatcatgttcctgaccccctccgagcttggcttcctgcgatacctcaaggctgccaaggtgcctctcaacgagtacgagttccccaacaagaagattgccaacgtgcagagccagctggagaagctcatctcgtccaactactggctcaacacctctgccaaggacggatatcgagcctatctgcaagcatacgcctcgcaccacctcaagaccgtctaccagatcgacaagctcgatctggtcaaggtggccaagtccttcggtttcaatgtgcctcccaaggtgaacatttccattggagcttccggtaagggcgccaagagcatcaagggtaaggacaaccacaagaagagaggtggacccggcggaaagaagttcacacggtagattgcataatagatagtggataaggaaagtaataaaacgacattagaacgaattatgagtggtgcatggcaatagaagtatatctgtacaattcaaatacgcttagctgagaattacttgtcagtactggttccagtatttgtaaggagtacctgtacattagtatgtatacatacttagatataccaatgcattgatgttagtgtttaatatgagatctcaaatgttcggttggccagcccgatgatgcgtgtagccgtattatgcgattataattgtccttcaaggtcctaaaccgctgccatttcccgtccgtcaccctccagccacctggctggaatgcgctcaaggaacttctgtccgtaagcattggaaaagtagtcttctgcagcaggtacgactggaaagggaaggaaccaaatgagtgggttggttccaaaaacctgtctccagttctttgcaaagccttggtcgaacggcagcgggtcctcttctcgcagaggttggatgattctcttgccttcatatctgaagttgactagaaccatgtctccctgttttcttccgagaccctccatggcggtaaggttccgacacactccccagaagctctggagacacacagaggtgcagaatgcggcccaggcacctgtgagaatcagaagagctatgatgtttccgttaggaatagagtcaggcgcgcccctgtcgcgtctgtattggcccattctaggggtgaaaacagctgtcgtcaccaatgtgtagatcaagtatgtcgagaacaaggtcgtgtactgtaggaagatcttgtagttgtgttgtccgatcactgtgcccacccagaaacacatgtggtccatcttggggacacagtgtcccacaatagccgagtggtgtgttcggtccggtttgtgtgtctggcattctgagcaccatttgggcattccccaaccatcgcagatgtaagtatctggcagcttggggttgatctgccttgatactatagcctgagccttttcgtccaccacttctgatcctggaatgaaaatttgcaaaggtgacactccagtcacctttccagggccaacaatgacgacggcggcccagtagatgaaaaccagtgtcttgagaatgcaatagacaatcaggagagccagccctgcccggtagcccatgtggtggtagaggttccagcagagaatgtagcaatatgcgtaggtgccatatcccaggagtccgagaattacgcctgggaaaacgattcgcagtgcctgtctgaacgctgctctgttcatttcatggtcaagtgtgctggataagatgatgagaatgtagacaaggttcctggtgtaaacaactctattgccaactgaacacgggagcaaccgcaccttaggaaggtcgtacttgcggggtatgagtgatgtgagcggggttttaccaagtcagattctgagaacccaccggcaagcctttttggaagaatctggacaactccaaggagattacagactgagtggcaattcacctttgtagagagacttccatgagctacccctatagctacttagagatcgctgagtcttattttgaaagacttacggttgagacgtggtaatgaggcgttttagccaaaaagattttaccagaatgacacacaatatcgcatgagtgatttttcaaactaatcatcatacgagtagatacagtacacactgtcgtactgtacgtacctataacacattccatcttcaagctgcatgttctcagcgtttatgcatctggtttagagctcagcggttgtcaggctaaactcccaaatcaagttgggtttgcttgcagctcatccaggtgctctttggagcttattagacggtcaacttggcacgatatcatcatcacacctccaccacaacagctatcaatatgagtgaagatggggatatatgcccgatctgcaaatcctcgcggtacctcaacccggatatgaaatttctagtcaatcctcaatgttaccacaaaatgtgcgaatcgtgtgtggatcgactttttgcctacggcccagtgacatgccctcacaatggctgcgaaaagattttgcgaaagaacaagttcaagacccagatcttcgaggatgtggctgtcgagaaggaggtcgatgtacgccaacgggtcatgtcggtcatgaacaaacgagaagacgagttcgacacgctgaacgactacaacgcatatctggaaaagattgaagacagcatcttcacgctgttgaatggaaccgctgacgaaaaggacgcattgaccaaggagatagaagcatacgaaaaggaacataaggccgagatcattgccaacaacaagctccgagacgaggaggacaagtatgagcagcagaaggaggactggatgaaggaacagagaaaggcaaactacctcatggctgtggaggaacaaagggcagctcaggaggataaggaggctgccaagcgagaactggttcatcagctcgccacttccaacaaggatgcctcttccatcgagcagaatgtccagaagacagctctcaaacgatcctcagctcgaacagtcaacttccaacccatgcctacatctcggtactttgagaaggtcaagaaggaaagctcgaagcccgagacgcccttcacacccttcaacggtgacaggcagattcccgcgctgtttgaggtacaggaccattacgacgacaaggtcatcgagcctctggcccatgacattcagcatcaggccggaggtttcactctcaaggcagcatacgcaagaattctccaacaggccttttttggtctaggtgtggatgttcagaccgagctgttggctgaagagaatggcaacagcaacggcacagcagtacctgtcaagacagaagaagacccggtcaagctggaagagccatcgatacaggtcaaggtggaatccacggtataacaacagtatttatatgcattatatttgaacaacaatgaagtatttatgacttgtgtatactacttgtagcaggtaattgtacttatagccacggtacctgtacagtaatcagctaatagaatggtgtttatacaatgcatttgttatggttgcccaagtttgttttcataaatacgaccgtccgcggctccatctagctgaatccacgtagcagaagagctccaatggctgcagtctccacctgagctctatcatctagagagactgttcctggtaacttgtataccttcttgacgagcttgatatctgtgttcttggcaatctgctcgtcagtaaagggctcttcggttccctcaaccagcttcgtgtactctcctccgccaatcttgacagccacaatgtttgtggtatcgtcctgaattccaaatctccttagagagtccatgatgttgttattccctcccagacagaacagcacctctgagtgtacgttttttgtcttcatggagccggcttcctgatcggaaacggctctgtagacggctgcgagcagatgcttggacgaaagcaatgtgttggcattaatgaaagccacctggtagtcggggttaccgcttaacagctcgtttcgaatctggccggcattcttgacgtctgaaaagtaggagatggcaatctcctggtcgaactggggaaacttcatgttgtggcagtgaatcacacgatctgactaacgtaatgcttttgaagagttcgggtataggatagtctggaatttgatactcagctgtgtggattccagatactggtactcgtaggattttcctgcagatggtggaagataaacttcggaggtcttaccacaagtaagacggtggttggtacgtgggatatatgtgctgtattgtgaaagaaggggttctacagacagcgattgtttatgaaacattccagttgatttattaagcagcacaaatttcaaaatttgcctcaactattgacaggtatcattctacttgtacaagtacgtaatgtacaatcatcctgccaccactccttcactctcctattaataactctatcttcggtgctgcatacatctcccagttggatacataaacagcatccatctaaacacctcagcaccaattgtataatgatttctccaggtgagtatgccagagatccccgtaagaagcccactaacgccagttaaaacctccgtggcttctccggccaccaccaagggagttgccgtgcatctctcctacaaccccaagaccaacgaggtggcttacgccaacaccaaggcagtgcttctggtgaatctcgacaagcccaacgaggctcggcagttcaatggccacattgcgccaaccaccgtcgccaagttctctccttcaggcttctatgtctgctccggcgatcaggctggcaacgtcaaggtctgggaccctgtctctttcaacatcaagtacgaagccaagatcggcaatggtcgaatcaacgatctcaactgggatgctgactctcagcgaatcattgctgtgggcgacggcacagagagatacggtcattgcttcactttcgacactggtaacactgtcggagagatctctggtcacggagctcaggtcaatgctgtcgccatcaaacccgttagaccctaccgagctgctaccgtcggcgatgatgccactctcgtcttctacaagggtcctcccttcaagttcgaccacaccgttaagcagcagcacagcaactacatccacgacgttgctttttcccctgatggaaagtggcttgtttcggttggagctgacagaaaggccgttctttataaccaggatggtgagcccgtcaagactattgacgcacatggcggctccatttactccgtctcctgggcccaggattccacccacttcgctaccgcctctgcagacaacactgtcaaggtctttgatgtcgagggtaaagagattgacacattcaagtttgaccagttccaggtcggtgtagtctgggctggcgattcccttgtgtcagttggactggacggcaccctgtccttctcctctgtgagcatagatgccctgtccaagctgtctttgactgagtccaaggtcattgcccaccagcagcccatttctgctgtcgagactctcaagggcaagatatactctggctctgttgacggatccattctcgagtggaccggtgacaaggcctctccttctgacgcctcccactctacttacattgtctctctcagtgactgtgatggaagcctggcatcagttgcttgggatgatacttacaagctcaacaacacagtctactcgatcggcacccagcccaaggctgccgattctcgaggttctctctctgccatcgtgactgagaacactctgcacatccttgatagcggtaagcttgtcaagaaggtttctattgatcggggctctgctgttgctattgctgaccaggttgttgtgggatctaagtcgggagagctctctgtctactctacaaccggtgagaaacagtttgatctccctcctcttcgtgctgctgccacaaagcttgctcttagtgaaaatggtaaccttcttgctgctggcgagtccactggtaagattatcctatacgacctttcaactaagtctgttgtcacctctcgatggaccttccacaccgctcagatcaacgatattgactggcttggaaacgagtacattgcctctgtttctctggacacaaacatttacatttactccgtcaagacccccatgaagaacctcaagtctctgaacgctcacaaggagggagccaccgcagtgcgatggctggcaaacaacgaaatcgtcactggtggtgctgatgctgttctcaagtggtggtctgttgagcttagctaaaggacataacactgtacaagtacaagtagacgaaattcatgaatcaatgcaacacactattattatatatgcttgtctcgaagactaagccatgcatgtctaagtataaacgattagcgcgtctacttgtagctcatgactatgcaggtttctactgtaattaaactataaatacaagtacatactgtatgtactgtagccttgtattctatgtatttgttaggacacaggcccggacttcggttggtttgtggtttgacaggtaatgccggcgacttgcctatggcaagtcgttgagcaaatactcgtgttgaaagggtcaataatcgatatcctaaatatatgggaaatgagagctatatataataatggcaccggaccaactgacggatctgtaactcggcggtcgagtcctgggggactcgatcgacccctacggtagtgggtctttgaccggaagggtgactacaaggatccccaatagagagttgacagataatcaagcaccgacgactgtcgacggtccttatgccacaggcacaagaaacaccaaaagaagatcgtttcctaacaggcgaccatcatagtaaaacagcacgagagcgctgacgaccaacagtcttctggtgctaagcttaaaatactgaataaatcgatttgtatgtatgtatgtatgttgttatcggtcgcccatgtatttgaggtactgaggaagacagttttcaggcatcagagaatccttgagatcgtctgtggtgaatcgaccaggcttgcatccatgacactttttggacttggggcaattgaaataggggaagtggtaatatccaatgtccttgaaccaatggatttgtgactggttagcaaatagtcctgcgccgacagagtgcacgggagcatctccccatctctcgtaaaagaaccctccctgtttatccagatgctcaaaccattgggcgtatgcatcgcccctgaagaacttcagagacgcgatttcaaagttggaccagaaatggcaagtggagtatccgccagcctgggcgttccagtctggtctgctggggttcagcaagaattgcatggcattgtctttgtgcagatactccttgttcttcatcaagaaggatttagtttccggccatagggtggcaacggttttggggttgtcaaacaatgcaatggtgaagccatacaccttgtcattgtcctccatgtatgcaaatacatcgtagtcgatgtcacaatagtattgggtgtcgggttcaacgcgccagtaccagtcataatcgtccatggccttgtgcttgtagaacatacccgagttccatctgcacatcttgtggtaggagtccatggcaccatatcgtacaccagcatcttccagcttcttgccggccttcttggccttgtccttgtcgatccatctgggggcgtcccagtccttcttttcaatcagctcaaacttgacttcagagtcagtctgttcgcgcaccttttccttgaactcgtcggtgaactcttcatcattgaaaaagatccaagggtagccgaatttgtgattgaatgtgtcctcgacctgcaccatggcatccacaataccgtccagctctttgtttcgaacaagagagataagagcggctttagttcgccgcgtgtcagtggcgcgaacaagaggcttggcactgacaggctcgtccacctcttcaagcaggggattgttcttcggcgttaagtcctcttttggttccgtatattgcaggaatgcatcgttgggttgcttgtagatgctctcctctttcaagaagtccgcatgtgttctggtccagtcatcttgtaacgagaagtagatcaggaacacgagcagaccgagcgaagccgtcaccagcagcaggaatagtcttctgactatcagcggggtcatattgttaggatgtggtcctgtctcaatcgattatagttaataaacctgtcgcgacacgcgaacactaatctagtgtgggcgttgtaaatatgtcccaaccaggaatcgaactgcgggatggaaaattcctcttccatacttggtgagaacacagatacagaacacacacctcatcacacaatgtttgggccttttcgacagtctatggtcacctttggtggctacgtccagtgagtatcatatatgagcgacacgaatgaaagtgttgcctagctatgcgggattttccagccactcaaacatcatctaaccatcagcaagcagcgataccgatggagattgtctcctacacagaaggctggccagcgaaagcgaatgaaggccgtcgactcagtcatggatgttctgcgatctagcatggagaagctcggcgtcactcccaagttcctcatcaaggctgagaccgagtgccctccttcttcggccatgctccccaaggacaagtacaccgttttcagcaagaaccacaagggttaccgaaaatccgttcaccgggtgcccaacttcaccaagactaccaaccgaaagaatccccttggtttctaaaatcccaactattggccctatacacttgtacatattaaattatctggtatgatgggaagatccagctgtggatccgagtgctgagattaaagggaagtaatgttattcattgaaagtacaagtacgtagtactgtacaagtcattgtagtgtagctagttcgtagattttagttacaaatactataatgtttccgctctatccgtaacacttctgtgtatttgcatgtggtaacaaatcttttggagcaaaattaaagagatggtatactgacatgattgtgttgatattaagctgatgttactgtagaggtgagaacacactacaagtacaagtacaagaattggtaagaaactatggttatgcgaccagcaccctccactattgtacatctctcgcagtagctacaagtagggcgcatactgtagcatatcaatttgctacaagtaccgacttcactctgctctcattatgtaattataaattaatcgtctatttaagtaatgctcatatgacccagccaacatttttttcacttctttcgctcagccttccacttgtagctgacatttccatccttgaccaccttctccttctcgcctcccttagcaagttctcgatccagatccagacgatgctccacgatcgccagctctcgctcacgctcgatgtgagcagccaacttcttcagtcgagaaactcgttctttgttgatgccctcgtcaagttcctgtgcatgagtctgcttctgttccagctggtccagcttcagacggttctctctcttgttcagcagagtcttgtcagtcttgaagtattcagcgggatcaaactcctcctgctccttctctgagttgacaaaaatggtatgcttgcctgtagccttgggcataagttcagcttgcattctctcaataactcgcagctccttcagtcgcatggttcgcacataggtagcatcttgagtctgcagcagcttcttggcatcggcactgagctctcgctcagctacatccaaagggttctccttgtaaccaataccatgttcatcggtcttggtgctatgcattccgaagtagaactcatcggggtttctctccttggccttctttcgcagcagcttgagctttgcttccttggcatggtaattttcagctcgaagcttgtaatccttcttcttttccagcaagccgaggtgccgtcgctcggcgatttggcttcgctctctgtgctgtttcttttggatattgtggacgagtcgagccatggtgtgtgtcagatgtgtaaatacttcaacaagattattttggcgatatgcaggcagaaatttatttaaggttgagtcacgtgatatatggagcaggaagatataggagctatagatgtatatcagaagatgttggtggcaaagaaactaaaaaataataataaatgaacttgaatcctctgtttgaggacttttctattacttgcgcttgaaagttccctaacaaactggtcatcgtgcattgttagttagtatctacaattgtagttgtacccagagggtatcatagttgagaatttgtcaactccataattttagtaaagaggctagaaaacaaattggaccttttgagtgcttatatacacatctctacgtgatgaatagacccgttactcactctctagaacccaccaccatcgtatctagcggcttttcattaaccccatttcgccaccactaacttaataattacaatctgcatgcagcgagcatgcctacaagtaggattgcaagttaacaccccaccaccaacgcgccatagctagtcccatgtcatttcaagaaagatgtatggaactcaagcagattctcaactttgatgttgacattttcacagccattattattggccttgctgcgcaacgacccgtcagaatccacactcaccatcctgatgttgtggagaagtgcgctcttgtggtggcagccaacattctaggctacgaccagagactactttaccgttgcgacgcagacgctgatgtcgaccactttttaaatggagtcagtgactggagagagtctgctcaaaccgacaaacaacttatgccatttctcatcctgagaaacgttgcatcgttatcgaacgagtgtcaggctctactgctggagattctgcaaacaggaaagacaacttacagaggtgtcacatattcgaaaccaccgggttttttgttactttcagtgtctaaaagtgatgtctacatgttcgaatacctgagggatgagttcttcgtctaccatgagtgtcacgtcgacggtgaggtgaatatcgcacaactaattgagagcatatcggaggaaaagactgcttcaccgccattgatgactgctgccgatatcaagaagctacacgacaaggcggcccaggtgtcgatagtggccgagctgcaacgatacatgcaagacattatcgtccatattcggtgccaccgggtggttgctagggctataaaacccaaggcagcaagagacttcactcttttcgtgcgccacatgtgcgtgctcaatgattcagacttcgcaaccccatcggtgattgcagtcgccgctcgaaagttactaccaagctctgtgcacattgcttcgccggaattcgaaccttctctagcctacggaagtgattataagctcattgaggaatacatcacatcgtgggatggagcactcgttgtggaagatgtcttgaatcgggtcaaggcacccgtttaagcctaactttgaccctcagcacttgccggtccccgaaacccatactctcagcatactaacaattccccacaccatatagaagttcatgaaatgtatataaataatctgttactgtcctaactctccccgctttgcggtaagtcggtttgttcacaacttgtcccaaatgtagtttgtgatgaagaatccactgtactccttgacgttgagatccagggtggccacgtttgaggttgtgttagatctgatcatgcattttgtgtacttctcaggcttctctgcgtcgaaagtgacacctagggttcggaacagcttgagctgtagggctgcagacgagtcgttctccactgcagactcgatgggctgctggctttccttttccacgagctcgagctcggcattcagcttcgaggtcgctgcttgcgtggcattcagagtctcctcgagatcattgatggcacgcgccaggcgcatcttctcgcgttccagctcatgcacatgttgggttctttcgcttgttgtggagtctccggcgaccgattcctggcacagatctctctgtcggatctgatcttgtaacttgtcacgcgcctccgctaactttgcctcgcgaaacagcgacagccgtgtgatatcgactgacactcgttctgtagacgcgatctcttcattggtgctgaatgacttggccacgtcacgtagcaggtcgatggggtccatttttggtatgtgtgtagcgagtaagtgtagagtgagctctttgggagggcttctgggtattttccaccgcgctgtttagctgctgtgagtgttgttttggttctgtatatttggcggattaagttcgacgagcagccgattgtacattcacaatagaaatcgtagagtctattctgactgtaggtgcttgtcctccacaacatgtggagaggctgaaatgcctcgctgacatacccgtattcgccgcaagaacaatggaaagcaggtgcaattacgtatattgcatcacaagacctctttgttgatgagacaagccacgtgctagagtcgtggctggtcctccgtctcagatcgatgagcgtattgctgcaagtcaaattgattgctattgcgaacatagaatgaattttatttgccgaatcaattgagactactgtacttgtgattgtatagtttcatacttgtacatacactggaggctgccccatattctgctgctgcctggtcttcgcacagctgggtcagtatgtacgtattacatacatactgtattcagtagttccaaagacttgtgcagccaagagagaaacccacacacaccagcaatggctcagggacaaggaccactgggatctcctcgggtttctgaaaatcaggaaccagaaggaaactctttcctgtgtttacgcaccccacgggctgtaggttgcgttgctcttccacaagatttcatagtcgtacatgtcagcagtaatgaagcgtggctgtgcggacaagcgaagtgacgttggtggtcaaaaggagtaaaggtggcaatgttcctcacaaagacgaacaggaacaatgtcctggtctaaagcttcagtgcaagttactgtaatgggtggggcttccaaaaatagttacacatatgacgcgttatacccagtgatctgtgaagaaacccagtggagctttattggccacactagtagagagctgaacaaaacaatgtctggagggttgacttggtagtgagttcattagtacagtatgtaccggtgcagttgctggcaacttttgggttatgactagtattagctagaaggggggaggtgtgccttgtatcgggtttgtcaagtgcagcgagatcgctgcaccaacaaatgccgcataccgtatatgactcgtattccatatctattgtctcacggttgccgtttgacaattcctttctgaaagcgagcaacccgttacacctcggagtcagcaaagaaacccaggaactctataacattaaacttctccccaaacttttccaatatctgacagcagtcaacagatcaccctaaacgaccagacacgactcgaaagcaggctattatcacaacggcccgccaagaccagtacgatatccgtattataccctatctccctttacatctttcaacatgcttcccgagcacggctttgagcacgaccagcccaccaacccccttcactccaacgatgtgtacccccaaaagtcgggtgctgtgcctctgtggttcctgtctcctaaggaagagaacgaggttcgggaggagacccgaagactagcacgaattgcatgcgccgatgtgctcaaggtctttagcgattgcacaaagggcagaaccgtgtccatgctgtgggcctgtcgaatcgaaaaggccaacatgatggagtgtatggcttcacactccaccatggaggactttgacagggctcgagatgagttcgttcaaaagaaagctgacgctatggctgagaacaaggaacgtctggcgcgggaacgaaccaagtctaactagggtgagacaccagctcacagaaagctgcagaaaccccactttaccgagccacagtagccctgcttctacacgaccaaccgacctatctccactattgttgcctacttgtagatatatgaccgacaggcactcttttttttgacggcacgacttggtccactgaccagctttaactccatgggcacgtctctcatttcatttgtacatagcaatatattccccagagcataaatcagatggttgtaagcatattacgattgcgtcaaaaccccaagagatagtgtggtgccgaatctaaacgtctcatctctgaatctgtgaatgccatatctcgaccaattgtcaaggcttgggcgacatacagagactctacagagagcattagatatagtgttcaatctcacaccgtattaaatccatctcctttctgttcttcgagaacaatctcaacttttcgtttcatattcatggttgcctttttgcatatggtatttctttctcatccatgattgctattgcgtcccaaactctgggccattgttacgtcatctgatctgcatatctacagctttggtccatgcatgtggtacattgggaaaacctccgaatatcgctcagcggtctagcactgacaattgattaggaaatcatccaaatattttttcaatctacaattcagagcctcagaattgttctgtagaaatcacgaagcggttgactcaaacaagaagctatggcagcctccatagcagcactcacatttaccttgctatgcgttaccttggacacctctaactcaatttttggcttgctacaactccacctgctctgtgtgtatataaaggccattgaagtcgctatggacgtcctcatacaaactactactattcacaatgcccaacattattgataaagcaaaggaggttttctcctcttcaaagaacgatgctaccactgaagctgacaaggccgagaacctgccttctaaggctggacaggaggtcaagtcgcaaggccagaccgagctgaagaacgcagagggtaaggttaccgacgccgctggcaccaagggcaagcttgcccaggctgctggccctggcggtgccaagaaccttggtgagggcgagctgaagaacctcgagggtcagattcctggccaggctggtcagtacgtcggtggaggaaagggcggtgaggctgctggaattgctgccggtgccgctggagttggtggagctggtgctgctggctctgccggccatggctctcagactggtaccaccggtaccactggtcagactggatacggctctcagaccggtaccaccggtaccactggtaccactggacagacaggatacggatctcagactggctctactggcactactggccagtccggttatggctctcagactggtgccactggcactaccggccagactggctacggctcttctggtgctgcaggttctaccggccagcccggttacagctccaccggccaggctgagtccgcttacggttctgctggctcccacggtaccactggatctaacactactggcactggctctcacgtccatggtgccactcagcctggtcagggtcagtctcttggccaggaggtgaagtctcatgttcccggtactgctgagcactctgcctctcaaggatctcacaacgtcggctctggcaccgctggtgctactggcgcgggagttggagctggcactggatacgctgctggttctggctcgcacggtgcttctactgggcagaccggatacggctcttctgcaactggcacacacggtgcttccactggagctgctggtactaacactgctggtggcgctcagtacgacaaccctgagcaggtccttagcggccagggcacccagggtactcagggttcccacactagccacactggtcaccacggccaccaccacggccaccacggttctggtgcagccactggagctgctaccggagctgctgcaggtactggtgctggatacgcaggccagacaggttctgctggtacgcacggtgcttcttccactggccagactggttacggatcttcttccaccggccagaccggctccactggcgcacgtggcacccatgagtctctcggcgagaaggcctacgatgccaagactgatgctaagtcccacatccccggcacttccgagcactctgccactcacggccactctaccggaactcacggcgcttctactggctcctccggtgtccagggccagggtatctctggtactcacggtgcttccggctctttcgctcctactcacaccaaccacaatgtgaccactggccccgagggtgtcgagcaccacattcaccaccaccaccaccacctcgagggtgacgctgctggtgctggtgtcggtgctggtgctggtgctgccactggctctcacggtactcacggtgcttccacaggtgctactggtgcctccagccagcccggttactccaagggcgattccactcataagcacggctctcactctcagagtggttacgatcattcttcttccaaggatcagtaccctgctcagggcaagcagtactctcacaccactcacgacgacacccgaggtcttaactcttcgtcctcttccgagcccgttcaaggaactggatacaagagcagctcttctggacctgctgttggcggtggaaagtactcttccaatccttctgcccactccattggcggtgacttcgccaacgtcggtaaccccagtgctaaccacgccaccactggcgagaagctccgaggtgagactgatgacatcacccgtggtgtctctggtgtgaacctccgaggcaacgaggctgccactggcgctggacttgctggtgccactggctacgccaagaaggtcgaggatggatctgctccttaccccggtacaaccggcgagcctacttccgagtacgcccacaccggcactcacggatctcgtggaaacaccaccggagctactggtacccattctggaaccactactgatgaagctggcaacgagaccattggtgagcgaatctccaacgccgcttctgctgtttctgctgcggttttcggcactggtgaggagcagggtaacacccacactgccaactccaccgcccctggtgcctacaaccagtctggcaccaccggtactcacggtactactggccagaccggttacggatcttccaccaccggtcaacctggctatggatccaccgctggtaccactggccagtacggttcttccactggtcctcatggcaccaacgagactcttggtgacaaggcctacgaggctaagactgatgccaagtcccacattcctggtactaccgagcactctgctactcacggcactcatggtactcaccacggaaacactgctggcgttactggtgctggtgctggtgccggtgctggtgccggatatgccgctggccagcagggtcagggacagtacggccagcagggtcagggacagtacggccagcagggtcagggacagtacggccagcagggtcagggacagggccagtctttcgtcgagactgctaagtcctacatccccggaactgaggagaatattgcttccaagcaggagcaggagtacacccagggccagcccggtcagtactctcagggccagaccggccactctcagggccagaccggccagtactctcagggccagaccggccagtactctcagggccagactggccagcactctcagggccagactggccagcactctcagggccagcgaggtcagcagggctccggtgctgttgagaccgccaagtcctacgtccccggcactgatgagcacgcggcttctaaggaccagtccaagggccagtccggagagcacgactctcacaaggggggttcctccgttctcgccactggagacgacaaggagtccaagaacctccgaaaggcccaggaggaagctatcaagcagcctctgcccactctcaagggtactgacgttgctgttgaagccgagcgagctcagcagggtcagcacatcaactacaaccaggcttctggtgacccctctgactccaagtcaaccatgatcatccgagatggtcttggaccccaggaggacatcgagggccccgtcggtgccggacacgccaaggttgaggaggagtccaccaagggtgccggtgagccttctctcgacgccaccgctgctcgagtgtaagcagtatacactttccttttttattaatagttgaatgaatgtatgttaaaaaacagttgttgaaaagctgctcgtagtacagttcattgtactggtaccgtggagtacgtacacggtacacttgtgtctactacgagtacagtacaggtacaagaacatacttgtagctctatgtacaagtaccagcacagtatgtacatagtgtatctttggtatttgacgacgggctacaagcgggtactcgtacttgaaaccgattgcagctgatggtatgttccggtatctgatggcctgtttcggtatctgattggggtctctcagtcgttggtattggaggctgtgctgcaagtcgatgtgttcttgcagaaaaaggtgattcaggcggatttgaatgagtacatacagttaaaaccgccaaccattgggtccacttacagttagtagaccattcaaatatattacatgtatagaaacataccaacctggcaattactgtccatatgaaccccttcaccatcgtaccaaacgaacatttgttttccctcgtttctttgacgtaaccatacaagtgacggacaatcttaatgtgctcattactctgtagcaagtcccaatgggtgtctataatgacactcgggtacagttacccacgcagggtgggagtacagtatacagtactgtgtgttgtacagtacatcttcgtcttgcgctgtacttgtgaacagtttctgagtgctattttttgatcatccaaattcctaaacatgataaactacaagcaggacctcgtcatcgagtgacatttcaacgctcaagaccacatgccacggcagtctccagagtgcgtttgagatgcggattaccacttaacagtgcatcaatgaggctgtgatttgaacctggctcgctgctacccaagtttcccgcaacgtaatcgcgcaaggtctttcctaaaacccgcggatagagggaattaggagtttagggaaaagaacgggccaaattcgaaagtgaagtctcgaaaagcataactccggtgtgtaaactccgaagaagtataatcctgcgacaataagccccgagacggaatatacaccggttaatatgggtcatgagacaccaatcgagtattgaagtgaagggaaaaaatcgggctgtgtatgccctccaattttctggtcttcagcttctctgtccattcgttatatccgaaaataactcggctccgcctccccccattgggagaaaccctatgcgttaaatgtcgcacggacaaagaagcttatcgttgccagccaccgcagcaatttgaatatcaagctactctagtttgtcaagagagagagagttgcacatcgacacactactacaacatcaatggctgtcaccaaacgagctggaagacgagctcaaggaggcactcaaccggctaagggagcgcaaggagtcaaaaaggcgaccttcgagtctggaaagaagcgagaggttggagtgtccgacctcacgttgctgtccaaggtcagcgaggaagccatcaacgagaacttgaagaagcgattcgagaacggaacaatctacacctacattggtcatgtggtgagtatggaaatgatggaggaggacagcggtgcctgacgctgatgacccgggagagtagaccgaccagtggaccccattgacagacaggacgagtgctcaattaatacattcagacaagaacgacagacacaatcaattaaatcaacaaacgactaacacagcttatctcggtgaaccccttcagagacctgggtatttatacagatgccgtgctggagtcttacaagggaaagaaccgtcttgaggtacctccccacgtcttctccatcgccgaatccatgtactacaacatgaagtcgtactcggagaatcagtgtgtcatcatttctggagagtcaggagccggaaagaccgaggcctccaagcgaatcatgcagtacattgcctctgcctcaggaggttcctcctccaacattcagaagatcaaggacatggtgctcgctaccaaccctcttctggaagcttttggatgtgccaagacgctgcgaaacgacaactcttcccgtcatggaaagtaccttgagattcagttcaacaaccaggcagagcccgtcggagcaaatatcaccaactatctgctggagaagggccgagtcgttggccagattcgtaacgagcgaaactttcacattttctaccagtttgccaaggcagcctccgagaactaccgaagcacctttggtatccagccgcctgaggcatacacctacacttctgcttccggctgcacttctgttaacggaattaacgatgaggccgagttcaaggagactctagctgcgatgaacctcattggtcttacacaagcagagcaggataatcttttcaagcttcttgccgccattttgtggatcggaaacatgtcctttgttgaggataaggacggaaatgccgccattgctgatgtttctgttcccaacttcgtggcctacctcctggaggtagatgccgagtcggttgtcaaagctgtgacccaacgaattatggagacctcccgaggaggccgacgaggatcggtctacgaggtggctctgaatattgcccaggccacctcggtcagagatgctcttgctaagggtatctacaataacctgttcgactggattgtcgagcgagtcaaccagagtctgcgagccccccaggatgctgctcgaaccattggtattctggatatctacggttttgagattttcgagtccaattctttcgagcagatctgtatcaactacgtcaacgagaaactgcagcagattttcatccagctgaccctcaagaccgagcaggatgagtacgtccgagagcagattgcatggacccccatcaactacttcaacaacaagattgtgtgtgatcttattgaggagaagcgacctcctggaatcttcgctgctctcaacgatgcatgcgccaccgcgcacgcagatcccaacgccgcagatgagaacttcatccagcgaatgtccatggtgggccagaacccccatttcgagcagcgacagcgaaagtttgtcatcaagcattacgctggtgatgtgacttatgatgtcaagggtatcacagacaagaacaaggatcagcttctcaaggatattctgattctgttgcagaagtctggaaaccctttcttggtgtctctattcccggatccggtcaacactgacaaccgaagacgacctcccactgcttcggacaagatcaagaagtctgccaacgacctggtgaccaccctttcggccgcccagccctcatacattcgtacgatcaagcccaaccagaacagatctcctaccgagtacgacgagaaggcagttctgcatcaggtcaaatatcttggtctgcaggaaaacgttcgaattcgacgagctggtttcgcgtaccgacagacctttgagaaatttgtggagcgattcatgcttctctccggaaagacctcgtatgccggtgactacatctggcagggatctgcctatgatgccaccctgtgcattctgcgagatgcgggtatccctcagaccgagtaccagatgggcaccacaaaggtgttcatcaagacccctgagactctgtttgctttagagcacatgagagacatgtggtggcataacatggctgctcgaatccaacgagcatggcgacgatacctcgcctacaagaccgagtgcgccatcaagatccagcgattctggcgtcttaagcgaggtttggatggcctcaaggagattcaattccgagactctggtcacaagcttctgggcggccgaaaggaacgacgaacttactctcttatcggctaccgtcgtttccagggagactatcttggctgcaacaacggcagtggctttggagatttcctcatgaagcagattggtgtcactgacaaggtcttcttctcgtgccgaggccagctgcagcagtctcgacttggacgatcttcggtccgtgtgccccgaactttcattctcactaagaacaacttctacgttgttgcgcagcagattcaccagaagcagctggtggtgaccaatgagtacaccattcccgtacgaaatatcacccacatgtccatgtctaacctgcgagacgattggttttgtctcaaccaggcttcttctccctatggagaccagctgatgtggtgtgtattcaagacggagctggcagtgcaacttcgagtcgtcaagccgggtgtcgacattcgaatcggtccccagattgactactttaagaagcagggcaagaaagcctctgtcaagttccagaagaccaccaccctgcagacgaagtttgacatgtacaagagtggatccgtccaggttcctcctggagcccctcccaacagtgttagcaaggagactcctcgaggccgagcaaagggatctcgaggtggtgctccctctcggcctgctgctcgaggcaacgctgcacacacccctactcctggcgctgctgcgctcggataccagcagcaccagcctggttctgctcagcccgcttctccccgagctcgaaaggcacccccacctgctcccaactctcgaggaaatggccatgctgagtctgcccagccgcaggcctacaataacctgcaaccccattatcagtcgttggttaaccctcgatccggacaagggcaacagcagcagcagcatcaccaggcttaccagcaacccactgccgctcaacccgcagccacttcatatagccctgctcccgcaaaggctgcccccccacctcctcctcctgctcccccggcagcccctgccgcccctgccgagccaacttacaaggctctgtatgactacgtggccaacggactcaaccagctgtccatttctgccggtgaacaggttctcatttctgtgaaggaggatcagggatggtggttggccaagagaatggacggctccgaagagggatggacccccgcagcctacttggaggaggtccagggtggcgctgcagctcctccccccgctgctccaactgctggaggtgcgtctgctggagcctctctggctgaggctctcaagcagaagcaacagtccaatcagactcttggtgccggtattgctgacgccatcaaggctcgaactgggcgacctgctgacgatgatgatgatgactggtaattatgtaagtaatgtgcaaactatgatacgatggattgtctattatagctatgaaacccatagttgattttttgcttgtactgtgtatcgtgagattgtattgtagctaccgaccggtatgtactgtatcgtacttactcaagtacaaataaatatcgatactaatacgagtacatcgtatcatactcgtctgttgcaaatgaaaattaaggttgacttactactgtacttgtagtacatactgtagttggatgcggctaagcgagtgatgtatgaagagtatagatgagtaatggcactcgtacttatgaacagaaataacacacacatgtatactattacatctctgaaactgaatgtcatatgcctattccttgtatttgtagttgtagattcaaacaccatcgaatcttgtccaccctcgacgcgtcttccccaaagttgaaggtaaatgccggacgcgaagaaaggcatcacgcccaacagcatacacacacaaccaagagcacactgccataccagtgactttgagcatggcatccaaagaagtgagttcaattacacacattccaccgacaaaaattctgactaactaggcaacggtgtatgtggtggatctacacgagtccatgggtcgggagatggcccgtggacatgactccaaagaggtgactgatcttaactggggtcttcagtacatttacagcgaaatttccaacaagattctgtctggccgaaagaccgacgtcgttggactggttggagtgcacacagacacgacacagaacatgtttgaggaggagtcagggtttgaacatattgacatcatcacccccatccagcagttcaacctcgacacgctgctggaggccaaaaagcagctcgtgcccaactccgacaacaaaggcgatctcatttcgggcattgttgttgccgttcagatgatcaaactgtacaccaaggctctcaagtacatccggaacattgttgttctcaccaacggccagggtaacatgaacctgggggattctggaggaattatcaagcaattgaatgagaatagaatcatactcaaggtcatgggagtcgactttgatgatgaggaggtggattactttgaggaggacaagccagaacacaagagagagaacgaactcaagctcaaggagttcgttgatcgatgtgaagactccgtctttgctacatacaaggaggcccgtgattctctggatatccccaaggtcaaagccgtcaaccctgtgcgcgctttccaaggcaatcttgtgctgagtgaccctgaacaacagcctccccaacgagtcatgtccattggtgttgaagtattcccctgtacacgacgcgcaactgccatgactgcttccagttacgccatgagcaaaattgagcctgctacgatttctactcctagccagaacaaccttcaggctgtcaagtgggacagacagtactatgtaaacgatgaaagcgggattggcggaaagaaggagcttgatcgtgatactctggaaaatgggtaccgatatggctctgagattgtgtacattacaaaagaggaagaagaggccatcatgtttcctacttctgcaagcttgcaagttattggattcgtcaacaagaaatctgttcctccttacatgctcatgggccatacagactacatcattggccagagaggcaacaaccgtgatgcagttgcaatctcagctttcgctcgtgcactgtttgagactgacaactttggtttggctcggtatgttaacaaggatggaaaagatccccagattgttgttttgatgccctacatcagggctgagctcgagggtttagttttctgccagttaccttttgctgaggatgagcgaaagttcattctgccttcactcaccagtctcgagacgcgatctggaaataaaactgtcaccacccattcgcggctacttccgactaaggagatgctcgatgctatggacgactatgttgatgcaatggatctgtccaagctgaagggcgaagatgacgagccctggctaaccatggaagagtgcttcaacccttcaatccatcacatcaggaacgtggtcaaagagtgtgcagtgagccaagactacggtaagatccctgagcctcttcccatcctcacgcgtttctcacagcctgctgaggagctcactgaggaggccaaaccccagctggagcttctgaagcacctgtttgatatcaaggagcagtttagagaagccaagaagcgaaagacagaagtgactgttggccagactggacttgatctcgacgctctgcttgaaggtgaactcgaagtgaagctagagtcatctcaaacacttagctctaatgtcaagtctgagccaggtaggcagacggcatctcagtcatctcaaaactctcaacagttgtcgcttgaccctgaaaacatctgtccagacttcatcagaacgctcaacaagattgataccaaggctacaagtgatgaggagttccggtcaggtgctaccaatctgtacaagcagactatcaccctattggaagagaagcttgagtcatccaagggaaatgacgcgtacaatgagatcatcggtgtgctacagactatgcgggaacaggccgatgagatggagattcctgacgtgttcactgctgccaagggtcagtttgtgagcaagctcgaaagaggagatttgggtggtcagaagaatgttctggttgcacagatcaactcaatttaagttaatatatatatacagtatatcgaaaactcaccagacaaatgtttttgtcgtggatacatattggtgacagttaccgcaatcaaacatcaaaataatttatttcaaactgcttactgcttaagttcgaacagtgggctcgtctcgaccaacaagctccttgaacttgaggtaggacacaacctcgttgatgatatcctcgaggtagtcctgggcagactcaccaaacttagaggggtcagactcatgtttctcgacgtagagtcgaatagtggcgccggaagaaccagttccagacagtcggataacaaatcgagcgccgttggtgaacttgacgtacagaccctggtgggaagagacagagccgtcgagatcggtgtattcaaagtcaccggcctcggcaacctcaagagagccaatcttggtaccgacaagagagttgagcttgtcgttcagacctgcaaccaccttggcagcgccttcgctagacacgttctcatagtcgtatcgggtaaagaaggttcgtccgtaagtcttccagaagtcctcctggatggcggcgatggaagccttcttggggtcctcctttccgacgccagcgatgatgttgagccaagcgatgactgcccagagaccgtccttctctcggatgtggttggagccggttccaaaagactcctcaccacagatggacagcttgtcggagtcgaacagggcgcagaagaacttccagccggtggggacctcatagacgttgaggcccttcttctttccaacgagatcgagagcgtttgaggtgggcatggatcgggccagaccgtaaactccctgcttcttgaagtaagggatcttatcggcgtggtcggcgatgatggcgacggagtcaccaggagaaacaaaggtgttggctccgtagatcatgtttcggtcaccgtcaccgtcggaagcagcaccaaagggaatggatccagaatcgacagcatcgacaagggtcttggcgtaagtgaggttggggtcgggatggagacctccaaagtcggggagaggagtgcagttctggatggaggacttgtcgagaccaagctcaccaaggaagatggcctgggcgtaggagccggtgacaccgttaagaccgtcaaagaggaccttgaagtcagggttggacttgaggaagtccttgatgagctccaggtcgaagatatccttgatcatagcgacgtagtcggcgacagagtcaatgatctcaatctcaatgggaccgtactgcttggtgccgacggtcttgaggtcgacctctcccacgtcgactcgctggtattccttgatcttggtggtcacgtcgaagatcttgttggtaacggactcgggagcgggcccgccattggcgaggttgtacttgattccaaagtcctcggtgggtcctccggggttgtgggaggcggtgagaatgattcctccagtggctcctcgctttcggatcacgtgggatgcggcaggggtagacagaataccgtcctgaccgacaatgagcttcttgacaccatttccggcggcgatctcggcaatgatctggcagaccttgtcgttatagtatcggccgtctccgccgatgaccagagtggcgtccttagcgccctcggggatggagtccatgatggcttgcacgaagttctcggtgtaatgaggctgctggaagacagtcaccttttttcggagacccgaggtgccgggcttctggccctcgaagggagtggtagcgacagcgggcattgtgttggtgtggtgtgtgcgtctggcaatgacaatgttgtgtgtcgtgtcaacagggtgaacttgcgttgcgttttgagtgaccttgcatctacctcgaactttaggcgcgtcaagtcgtacggtgtgtatgcacgatgttaggggagagcagccacgtcttgattgccactggcttggatgggaaaaaggtagtgtacttgtaccggtacgtactacgagtacttgaattcggagacatgctgaccacgtatatgcagtgcgttttttctcgtatatttttgccttctgagttacatctatacccacgggtgcaggatccgtggagtccgttcgctggtgatccgatcgcattgagcttccttgttggctgtcatggcgtctacccggggctgatctttttttttttagttggcaccatgtgggtgaagccctcgtaattgatggtatcgtacatgtgctatacttgcatttgaacgtacaagtagctacgtcgaactggccagcttgtgggctcactatacaaacttcgtgtggttaagaataagaaattgtgggggtcgtgactggaggttgaaactctcatctacaagtggacagtatgtacgaagtacatgttgtctgagacatccaaggatcacaggaacgatcacaccagccattgagattcaacactcatgtcactttggagctgacccaaagtgtctttcgagagcgtttagaccgcacaatggcgagaaaccgaaagtaagtcagccgtgccaataagtatatgtacgatttgacaggcgcaatacagcacgagggcacagtggagacacactcggctcgtatatctaagcgtgtgcctcacatacccggaatagccacggtgtggtacccatccatggaattaagcgaatattcggctccgccctcgcagtgcgagtacctaggcaacattaccttgtgcttccccactccttgctgggcactacgaatccccacctgagagcctgcataatcaggatttagactcgtctggtgtagctccccgcaagaaggacatctcaaaaactaagcgtgctgctcacgagactaagtgtaggggactaatgggctgacagacttggttgaaataataactcaacaggaagccaattgagtcaaatacacaagaatgcgcaatattccacccatctgtgtcgctgcaaccacccacattgctcgtgcactacttcgtatattaaccagataagggtctttacccctctgattcaaaacgcttagggtacatccggagacccggatcaaagaggggagagcagaatagcagagcaatcaggaccaggcctcctttattggtttccgtatatgaaaccgttatatataacggcggatatatttgattttattacatcttacaccaacatcgatctttatcgacaaccaaacaccatgactaagcttcattctcaagttcttattgtaggaggggggttctcaggaatagccacctccatcaaactgctcaaagactggaaggtgaccgatttccatgtctacgaccgtaacgagaagtttggaggcacttgggctgccaacacttaccccggagctgcctccgacatccctgcagtctggtactgtctagccagtgatcccaagatcgattgggagtctgcctatccatcgcagcaggagctgtctgaatacattgcaggagttgtcgacaaatacggtctcaagtcatttgcaaccttcaattctgagatcgagcgaatcgaatggattcctaacgagcgcttgtggaaggctaccatcgctcacaatggcaacaccatcacacacactgctcgagttctcttcatgggccagggatgcctggtaacacctaaccatgtcaagatcaagggcatggaagactttcagggtcccattatgcatacagccgagtggaagccgtttgattacgacaacaaggacgttgttgttattggaaacggatgttctgctgctcaggtcaccagtgaggtggccaaaacagcgaagtcagtcactcagttcgcccgttctccacagtggattgttccacggactccagtcactattgggcctattttgcggaccattctcagttggttcccgttcttgatccctgtcctgcgattcttcgtattttgcttactggaaatgaattggaatatgttccgaggaggctggtggtccgacttcgatcggtctatgcgaaccaaggtggctgtgaaaattgccaagaagaacatgcctgaaaagtaccacgaaacagccatccccaagtatcagctcggatgtaaacgaatcatcttcgattgcggctactgggcagccttgaaaatggagagtgtgcttctgacctttgacaagctggttgaagttggaaagaactcagtcaaggacatcaatggcaaccagtatccggctgatctgattgtggacgctacggggttcaacattggacgatcaatgacctctgtggatgtgattggagagaacggaatgcctttatctgaattctgggatggcaaggtcgctgcgtacgagacggtcatggtgcctaactaccccaacatgttcatgctgttcggtcccaatgccacgactggacataactcagttatcttcggtattgagaacggtctcaagtttgtggagtcggttgcttccgatgtcatccagggacgaagtgactacgtgacagtgaagccccaggcatacgaccagtgggtgcagcgaatccaggctgctatcaaacagaccaactttgccacgggtgggtgcgtgtcgtggtacatgtctgttggagaagccactcacaatgccgtttcctatccttggacccagctgagattctggtggagagctcgattcccccattacgacgacatttatgttgaaaacaaatctcagaaggttactccaggcaaagcgatcaaggccgagtagtttagctacagtagtagcccttagtgtcagtttaggtctaatattatccacgtggtatatatacttaacgactcgtatcataatatatacatgacccttttgcggatgtactgtggaagttggtatcaaactggtatcggtacttgtgcgtacttgtaggtacagtacgtacgagtacttgattagggatgttcatctagaataatctgcatcaacaaggacagttgatgttcccaacaaaatagggacacacaatcatgtggttcaattccaacttttagtcatcaagtgtacacaggaataaaaccacaggcaaacttgataggggtcacaaaggcgatcataaaagtacatagaaacatatagctttgcgtttatggggctgccgactacttgtacgaatagttacgtggcccgtaccctcaaatgtagatcgccaccgcctatcggggttaggtcgaaaacctaatgacatagaaagtactggaagctccttctatctcagtgtttaagagatcgaggttccttcgcacaaccacacaacattaccccacaatcacacaatgagcgactttgaaatcatcatcaagtaagtgaaacgaaaagaagcaatgtctgcatcttcaaagcgcaattactaacccaggtcttctgacaaaaaggtcccggtgtctgtcaacaatgataccctcgtctccaaggtcaaggagcagatggcaaaggagctggatatccctgccgagagacagcgactcatctactccggccgagtgctcaaggatggagagaccgtcggatcttataacatcaaggagggccactccgtccatcttgtcaagggtgctgccccccagggctcctccgcagcttccgccgctagcgccacctccgccataaccaacacagcttcctccaatcctgcttccaccggaattcccaacaacatcgccagcggtgcaggtgcaggaaaccctctggctgcgctcactggagctcagtttgctggccatggtatcaaccctcagatgtttggagatcagtttggacagcctccctccgaagaggacttcattaacatgatgcgacaacccggctacagagagtccgtggaggcgatgctcaacaacccccagatgcttgacatgatgatcaactctaacccccagctggccgccatgggcccccaggctcgacagatgctgcaaagcgaccacatgcgacagatgatgactaaccccgaggttatgcagggaatgatgcagatccagagagccatgaatcccgaggctcagggctctgcttttcccgctcctggcgctgcccccggtgccggtgccggaactgatggcgctggtgctggagctggtgccggtgccggtggtgctgctgggggagccaacgccaacaacatggccaacttcatgcaaatgatgggtggtggcggatttggtggattgggcggtggtaacgctttctctgctcctgctgctgagcccgaagacactcgacccccggaggagcgttacgagtctcagctgagacagctcaacgagcttggcttttacgagtttgaccgaaacgttcgtgctctgcgacgaagtggaggcaacgtgcagggagccatcgaggctcttcttgacggtggtgtttaagtcaagagatgattagaagagtgggctaccggggtgggacaaacggacgtttccgctcaatgacaaaccaatgtacgcatatatatattcatttagctacgtgtaccaactcctgcatcagcagtatcagagtcagaaagttgcaactgtattaattatattaaatgattcaaactactgttccggtgctgcatgtactggcacatacaggtacaaaaatgatcatactgtagatactgtatacgaaataattgatgttaaataaaacaatgcactaatatctataggtctataattaatgatacaatgaccttgcccagatcaaacttgatctcctcttcggtcagggataacaaatccaatctcgggagcaggtcgagtgtaagtgtcctggctatcatctgtggtgccactctcatcaacgacatggatgttttgtcgaaggtctgtggggttggagatggcatcgatcttgacatggccctcggggtctcggggggttcgatctcggcttgcagatcggcttctggagaagcttcgagtcatggtcattgttcgagacagagtggtggggagctgttttcccagcatactcacagggattgtaataccatggacaacaaccgacgacagaatgaggaagtacactagagggtacatgacggtaatgagccaatgagggtcgtaagtgtgggcctcaccatgctcattctcttcaacaaactcatcaagcttgttgagagcagtgtggaggtagaagatggctccaataccaatggggccaaagaagcccgcgaatagcgcttccttgatattcttgatcgttggaatgaatttgtagaaaacaagcatggcgggaagtcgtcggaaaaccagtacacagattccgcacagcacaaaccgccagacgggcaggttgaggtggggctggttgaactgaccccaaggcatgacaacgccgacccacagaaagattgcaaaattgagcattaaatccaatgttggttggagtgtgtcgtccttggtttcctctcggaaccaatcgttccaagtgaacgcgtttcctgcaatgaaggcagcaagtaggtcgtcggttccaatcatgcctgcagttcctagaataaacagacccaaagcgaagacgaagaccaagaaggactcatcgtccacgaagttgaacttcttggcataaccaagaagctcttggccgagatatccgatcacggcaccgtaggcgacagaaagaagaatctcgtagagaatggtctcgacgatccactccttggcaatcttcgtgcccgagtatctgtcaatgtagagagccaggaagaggaaggggtatccgaagccatcgttagcaccggactccgccgaaatgatgtttctcaacgactcagacacatacttctcggcgaacttgcccttgacgacggagttggacaggacgggatcagtaggggtgacacacgagccaatgataagggcgtccaagtatcggaggttggggaaaatgagccaaatgatgagggcagtgacgacccacatggtggtcatgacaggcacaagaaggaagaagaaggatctccactccttaacgaggtacttggctggaagctgcacaccagcgaggaccagctgaattcctagaacaagccgggagaattcgagggtgatttcacggacgttgccgtattcttctggaattacccatttcgctttattgaaaatcagtccaaataatagagcagggagggcttcacccatgtagcaatgctccttgaccacataagaaatcagtccaaaaaccaatgcgaatccgccaaggcatgctgtaacaatgttgaagttggagatgttgagaactggcatcactcagaaaacgaaacaagaagatccgcgaagagagacgacagcaagaggtgcaaaaaggacgacgggcctacctgatatcgaggtgaaggcggagagtagtgattttaggggacgacacttttgggagaggggtagctagtggagctactagtcgatggagagcgtgaagtgttcttgtgcgtttcggtgcacttctcaagagcagggatgccggcttatgaggaggttttgcaacacttgttggtgtagctgccaagacttttaaagtccgcgcttctttgatgcactagccctttgtcatatcgaacttggcatcattgtgccaaccgcagccaagatcctccacctgtgtgtctctcgcttatctccatagatcgtcaaatctcccttcactacatgcttggtctacatgtttccaggttatattcgtgatattcctcagcctacggccaccccctactgtattaactgttagagcaggctatggttttgcgaccgcggcttgcgctaacttatttttgcctcaaacagagttcctgctcgccaaatggattgaatcttattagctagcgggtgttagttctctttaattcttctttttcctctacaagtccacaacgtaggagcaaaattgtgggtggcagatacatgtgtttggcggctggacatgcgatgagataggaccaaaacatgtgctaatggagcatatggtatcatgacaggtgctgtagcaatctcgcgagcttcaccagatcatatcttcatattagaaatacgagcagctcaattttcctatcgtgtgacaccgatactcccgcaacatatatatatatacagtatgtggacctcttttcagttgcacacccctcgtcaaattagagtgacttttgaattttgcgatttacagtctctttctgttgaccaactgcaccatgacttcagcgcacgttttgcggcgggggaggtaggaaatccggaaatatgcgactattaatgaaaaacgcatgccaagaaatccggaggagggctgctgcgagaagactatgatacccaccaagcgggttatatagtgggatataagtttctgccatttcatgtttgagaagtaaaaaccgttaggactgattaaacatgaccctggctattcgacagaatatgcttatggccttgtcgtatgcgcaactcatggtatggtttgaacagaagacctacggcaagtgcgcacggcgttaactttttaaaatgcccgaccaaagatggccactagcatacgtggtatctcctgtgcgtgccagatcgagacaaagaatctcaacagatatggtccattcaaaacgtatagaactaagactcgctacaagcactcgtactgtacatacagtacaagtaatgcaaggatggtggaaccacaactccatgttattagacatttacagtaactgtattttaactccgccatctgttgagagcggacactttgttcaccattaattgcttgcccgagtataagagatatcaccgaagaattatggtgtcgagggtgtgaatacacatggaatgttgccctgaagatgaatgggtagcagcagttttagacagccacaaatagtttctgtacatctctatggccaagagcccttcaaccacgatgtggcagtgcctggtatgcacgtgattataattaaggttgtcattgggactacagtagtttaactatattgcactgactggtcatatgtgattaccctactggcaagatgggttttacgatggcacattatacaactcgagctttgtacactctggtgatcgctgtgtggagattgtcattcgtgtctttcgtcaaagtagtcccaagtcggacagcagctcattgtcagaagactgttaatttcaactaagtatgtttggtctacagcttcatgaactattttttaagtaaaaacagagggttaattaaaaagtcaagtatataaccttcagtcactaccacaaagaactgtgtcctgttactcgtactgtagctactgctaaaaatatttcgactaaacatgacaatcacctgaaagtgcacgaatcattgacaactaaaagaccacatgttatcctattcatacgttatcatgcggtgccagaagagcgccaattctctacagtcgaatcaggacgctggtgaggtttgccaaagctgtagaaaacatacctaagaggctcgaattacagggtatttgcccttacttacagattaagccgtctctctagatgtactgtaccactgtatagctccaccatagagtcagtcggtagcatcgtttcatgaattgtaagcataacccttgaaacgagaccacctatctatctacagtatggcctaaaacccttgcacagcattcattgaacatgtagcagctgtgggattgagaactattgcggatctacagctacttgtaattctgataccgcagtgattatacgtctgacacaggagtttagatacaaggctcgtatatgccaggctgtggaacgaatgaatgaaagctgtacttgtacatggtgagggaggagggggagagtgtcagctacgtcttagtcgagatctattagagataaggacaccgagacagtctgttttcaaacgtagtgaactccaaggcttctcccatacttccagaaactgactacttgtatagacagaatgggcagacgagataggcaacaggttgagtctacgatatctcttcaaattcactgaccttagaaagtacaagtacagtatttgtaacgatcccaatcgttcttattagtctctcaaagtgagagcagcgaatgagtggttatgacacagacaagtgacgggaccgacctatggggctctacatgggttacaagttgtcacggttcgcatacagccatgtgacactccgaaacagcgtctaggatagcagatataggacggttcgaggatgattacatttcacatctagaagaattggattaggaagatcctcctgataccgctggtctccatacatatccgtcaaactactatacatactgtaggctgctgtacaagtacatacagaatatacttgtgctgtatttgtgacatgttcatgatagttatcgttcttatccgagcaatgcccattgagccgccgttctcgcagtcgccatattcactcaccacctcagctagtgaagttcataatatctccccgtaacttattcgcccgctctcctcttgatgttaccggggccacagtatctatgcttctgagcttgcaaggtacctggtatgtagagcaatcccaaggccagagcgagggggtcctgggtgtgacacttcaggctctcttgtttgggggtaactgtatctttgactacttgtggttccacaactctcacttcgccgagaaccgcccttgttcaggaagaaccaccggcattcccgaacggagataacggtccacctcaacaaaataacgccgtatctattacggtaccagatgatcagcagatacacacaatcagtacaataccagattctacagcatgcgctattggcaactagatgttgcagatcaggatggatatcagggtcctcagactggtcctgaagttgattggtagaaaggcccgtcatgtggtcggatctcccaacctctgtgtctctttattggtctcataggcctcaccatcatcaacctcgtcatcaacctcaccataaacctcagtcctgatgacaccccgcaccccaagcttctaagaaatattttgatactggtgtgtttccacatcagtaaatctgtcaaactttcaataaattgtacttatacaatacaagtacttattacacgagtaatttgttaatcaatacgcttaatgaatgagaccacatgtatgagctccccaaggtatcataccacaccaccgtacatacagtactcgcagaatgtaggggtatggggtaataatactgttcctcattatttcgaatttttagagtattaggcgtagcccaagcacttgataatcctcccaagccccaagtggccttatttcagagagtcatgtatagcctaatcttatttcggtgaaattgaacatctcgcgatagtcatagctaattaattaagtacgaaaacccccttcatgacgtggcccaattttacaacgacgataaatcactcattttccccgttttttgtgagtattgaggctttgcagcatctgtacatgggtagttgacaaagaaaaactcaaattactaaaaaaccacattggccgaaactcaacacgcctagcgcgctaggctacaatggaggcactcagtcggacagcataagagagtcagaactgggacagttatcgtcttgtggccccgagctggtgtcagaggtgggactgtcagcaaatagcgagggtgggaccttcgaaaagggaccggcacgtcgtgtggaccgctgtcgtgtggactgctgtcgtgtagactgctgtcgtgtagagtcctcctgtgtgggctcctcctgtgtgggctcctcctgtgtgggctcctcccccgtagaccgtgctgatcgctctcgcctagcgttgccgcggtcttccctggcgccaatggctgcgaaaacgtcctggctcgaaattacttgatcaggtgcgcttcggtttactctgattctcttcgttttgcttctgacgatgtcgatttcgtgctgtcgcatagtggcatcctcttgcatgtgatacaagtcacccaccagtctatcgatcatctcaacaaatggctttaagccgtgaatgaggaaatctcgcatcgcgggatgcgtgctatgagcccatgtaagaagggcgtttccacctgtaggtggattctccatgggcgggtacgtttctttgcagaaaatcttctcaatacaatcgtcgtgatgccagtgcgagctggaaaagttgtggaaagcctgttgtgagccgagtgtttcgtcagcgtcaacctggttggcgttgttttgacgttccaatagttcctcgttcacagctgctaagaactcgtaatcgctggcgtccatggcaccatcgttgacaataatgtcagaggcactaacgtcagagtcactagaatcactagagccactgccgtcactttcagactcgctggtacacttgtacgtttcatcatgggtgtcgtcatgaatggaattttcaagctcttccaggcttggctgcaatggcatatcggggacagcgggagttggtgtgttgatcggaaagattgctctaaccgtgtcttgagaggtgtaatcttgcctcacagctccgagcggctccttgtttccattctcacgaatcagcctcggattggagcgaattttttcggggtcgagtggccacagtccgctggctctccatccagacgctatgttgctctcggtaagagccttctcacgcacctcgttgatcacagtcaagaatacgtgcggccctgcgtcagtgaggtttcccacctttccctcattgccagccaagtctttgtaccaatgtttcatggagctgaacacacccacatcaagcggctgggtaatgtggctggtgtggggtggtaagagaaccgtagtgatgttgtgctcgatgcatttcaggagaaacctcttctgcgtgtggctgtgatgcccatccatatagagtattcgacgaatatgaggggcgtcgttcccatatttgtctttcggcatcgtgtcaggaataaaaacctgcgtcaaccatttccaggcagtgttgttgttcgtgaagccagaatctgagaattcgaacaccatgtccttgtaatcttccgcacgagatcccttcggaaaccattgaccctgcacggtttttcccttgaagatcaccaaggccctcgtgctttttccagttgccgagactgtttcaataaccgttgtagttgcgcttctgccagtgacagattgaatggcaggttcacccctgagtccaaccacttgtccgcctcttccttctccttgttggaacccagtttcgtccatgttccagcggttctctggaaggacctcctccagagtctgggaggtgatagttgtaatgaattcttcgagtttatcgtgtgtcgtgccatcgattctggcttgttccaaagacacgggccgcttgacttcgagaagattatgacgagtaacgaagttggaagcccagttcttgcccacggtttcagtgttgccgttcgctttgagcaggtagttggcaatctttgagatgtcctttagcttgacgggtctggcaatggagtgttggaatttaacgtggtccaacagaccccgctcgtgagcctctgacaattttttattgttgctatgagcccaattcattttaagcgccaattccttgtaggaaattctcatcttctcgatccagtcgggctgtagagaaccatgttgtttcagtagacggatcctccacgagacggtagaatcaggaacgttccattttttgcctgctgctttgtgagttgagttggtcctgatcacctccatgcaggctttgtagaggctctctggtgggtactgcttcctcttccgcctctcttgattgttgagcatcgctgtttcaggtaaggtgatctgagtggatgtgagttgatagctacagtagctatcagaacatagctattggagatacgggttggcacagtcacaattgacgtgtcttggtctatgggtcatgtgcatgtatctttggggccaacctcttttgaactaaacctccccagcacttactatactacaatagacgtgattgttgctatccaacagacggaaagaatcatgttctccgtccccctacaaaacccctactctagacagtcactgtaaattcagccaatcaaatcggccaccctgagtcaaataaagtttggaggttgctaattttgtgcatcagagacgcacaaataaggccacttggggcttgggaggattatcaagtgcttgggctacgcctattccgtcacaaaattttacactgacctggccaatagcgtgtatggaaaccactgatactgagacaagtcactgcagtacgcaggagaacatgtcccggaaggcttgcactttttgcactaaattctaatattatacaaggatgagtacaatacgttgacagtgcggctcaacacgtttactctgaccaacatacgtcatcatcctctttgcaaagacaggaagctaaaagtccaacgtgccatgagtttaacgggtgagtgggatcggcaatcgaacctagtagccgctatcttccccacaacggggccttcatccgcttcattgagcccacttgccttcaggtgattgttctagttgtgagaccaagaagcaacaattatcctcttacgtgctcggctcggcaggtaaacttcatggcatagatacgcgctacagtatgtacttgtagccacttgatggaacttgctacaaattcacaaccaaaatagttgcatgaagttgcctctttcatgtggggttgaaaccgcgcaattatgtgagagctagtagagctaagggaaatggagcggcagaaactcggacgaaatattgctcagaaatacagtacgttattcctgaagattattaccgactcccgataagttcggtatctgggttatactgcgcacaaagtttctctagtgcggcatgagggtgctatcaagaggctatgtgtggtgcactgtgtgcactgtgacatctgtttttatgtgagcctcgggttccatcatgagctacaagtagccacttgtactgtactgtaacagaattccaggtctaactaaatttaaaatgagacaccaagcttcaaaaacttcgctattctcgtaactgtgacccacctgagtgtcaggacgtccgctttcaggggatgccttgaagctagaacatacttacaagttgtcgttttgcggaaactcgatgaacttacctttagtccaatagccggtctagttcagtgtgcaattaagacattatgtttcgtccatatttccgatcagcccccagcttctaaatgagacgtagctccaagccccaatgacgaggtccaaaaactgcactgatttgtaccagagacgaacactaaaaggcttctgcatgtgtctttggtcatgtggccgcaagtgtctgacaagatattatgcgtggatggtctgtagagaataatgagatctcacgcaaaagtaccggatgtggggtaaggggagtttaccccaacagctgctccaaaaaaataattcacttgacagcctctctcttggcgttttcgagtttcctgatggcttgcccatggcaaatcattgtagatcatgtatggtgctccagattgggtcagcaggatgcagctcacatgcacacctttgtgcactcttttaactccatggcctactgctgcacacctgacaactacaagtaactactgacagatagcaatgtacataaacggtagatgcacgtcgtgcggtagtccgtaatgttagctcaattgacacctcggatatccgtattaattagcagatcttctaataataatcccactcttttcgccactacacgactcaccgcacaaacggttatcaaaaacaacgaaacaagctacatgccacacaaagccctacgataaaggacaaaacgatacgctgcactccagtttcggggaatagacagctgaaaacgttttcccagttattaatacgtcacatatcccaagcaccaggggatcaaacctcgcagtacacttccttcagcatagcacacctgaaaccaacctacatatccatcgtcggcaacgtctcatctgaaacaaaagggtattcattttctccagagtgcagagtccaaaactcaatacacgattatcccccaagaacatgaaagccgttcctgcgcaaaatggcttcttataaaccctatccaggatcggattccagcaaccctacgagctctccaggtgaagccaacaataaccactactccactccgagactctcatcaccagcagcagctgagagtaacagacacacttcagtttcgaccttgcccgcaaccgcagagtgggatcagttgccgtatccttccttcaacaactcaatacaccataagtcacagagatctacatcgcctcgttcaccacgaagtccaatgttgccacctcaaacaatcagcaaccggagattctctcccagggagtctcctgccatctcaaggcagccatcccaacgaaccagagccagatcatccaccgtcacttctgatgatggtcgttctgtgttcatgtctgagttccgcaagcattctggatcaggagcgcgaccagatatgaaaggcttgtatgcagatcaagttggatctgaacaggctattgcatctgatgacgactctcttgttatcccagggaccatgcccagatccaatccaattcccagatctgagatcgaatccgaacccatggagcggacctcatcatcgaagaggtcttccaagatattcacaagaggccgagtctcccctgacggctctattgctggtgacgactccgagtctgggttcatggcaaaggtgtccaaactgttgaagaccaaagagagcaaacaagacctcatcaatgacattctggcagatgaagcggccaacggaaactcccaaatgtacgaggagcattaccaacaaatgcaagcagggactctgcctgttgaaacgcaaccctcagccgtagcgttctcaccacaatacccacttccataccactaccccgaaactgtggctcatatacagatacccccagctggaactcagctcgacaagtctgctgagtatgaccttatgatgcaacgacaacaagaagagtttgcagctgatttggaaccgggtgattcaaaggtgcccaaaaggaagtccaattcaaagaagagcaggagtgcttcgccttcccttcatggcattggaattgatggaattgatggcatgatgatggtagatggctcgatcgaccctctgaccgcgggccattttacacacagcaagcatcatcgttccaagtccaagacatccaaaaagtcaccgacaatgtcacctgcgatgctacccactaacccacaatccaagacggtgccctacccgtctcacctttctcgaaactcgagtccgcccattgacatcctagagctgtctgctttggataaaccttcaagcagccgtcgcaagatgaagcgatctagtaagaagagtcaaaccgactatggcaagatcatgcgccacctgtataactcgatcccgtctctcgatgtcattgtcaaagtagtcatggagcctgtcgaaactgcaagaaagtctgaatatcccaatttggcaattgttattgctgtggtagagctgctagtgtttatttggttgctttatcaggcaataatcattgttgaatttgcatgtgccgttattcggttcatttgttatccggccatctacatcctgaaggccattgcgtctccatttgcatccataaagagagtctgactacaagtaggaggagttcatagagtcttagacaaacacaatatcaatgttagattttcctacacccgcttgtattagcacctacaataaggttcgtattcatcactaagatagaacagttcgtctattaaatacattcccaacctttctatattagtctaatcaaggcatagtcattcatgccattcaatgtcaatgtgttaagcctcaagttccttgacttcaggagcctcattgacctcaagatccttgttttcggtggttcccttctcctgcttctccttctccttctcttccttttctcgtcgcatcatctccttgagatcatcttctgatggttcgtacatgtgccaaacggtgtagtgaggcagccctcgtacagtgaagcccatcttcttgcacatctttccgaaagcctcggtctcagcatggttctcaaaagtgaaaccggtgaagtgagcacctgacaggaacacacgagatcgggcgagaatggaaacacctccaataccgtcgagatcaacctgttcatcagggttaccgtcagcgtttctgacgtatgccagatggggccggtacgtagggtactcagcgtaaccctccacgatgacctcatcctcgtccagtgtagcagcgagatcaagggcaggctgggactcctgccacgagttcaggtcgtagggctgctcacttcccagccaatcaggcagaggtctccacacattaggaacaatgacatcaacgttatgcttcatcagatcctcgatgatggtgggaggtgaggtctcaatgtcggcatcacgccagtagacccaggaatgtgtgggctccagcagagaagagaggagccagtttcgggcccggcccatgagcttccttcgaacaccttggacagcaacgccgtgtctgtcagagaagtctgtaccgacagcagatccaaagtcacggaacagaagggtgatcttgttgaaaggcattttggggtcggcgtcgctctggatcgagttgatctcatcctccagcacattgacggtattgtcatccgtgtccgagatgagaaaagcgagatcaattaggttgtggtcatatgtgaggtttcggagatgcgaggccatgataggaaccaccttttctacgtttcgcaggggcatgcacaccaaaacgcgttggttcaggggactgtttttgctccagtcaccggctgcgtcacgtagatcgacaaagctgacctcaccaaggggctttctgtgagcctcagcagggctctgtgagcttatggatccctgctttatcgaatccgacacgtactgcttgtatccctgtaccgattgaagcacgtcggagtagctgacctcgtggtgcgaaccaaaaaggaacacaatcaacgtcacagccacaaaaacagcagctagacggagctttgtgatttgtgggacctgcaggtttggtcgtgataatggcgacggctttcttggcttaaaatcggttctgtagtcgactccaccagtcttttcgtacttgggcagctcgttgggctttttgtctctcgaaatcatctcgaggcgtgatgcagaaatgaagggaagccgtgtgtcgtgtggcgatggagaggacgtcggtgcctagctactgtaagtggataagcgaaagagctcaatgctagccgtgggggatatgcaagtattatgttatggcgcgaaagaccgcaatccaggctgagaacttaatgcatgtctcattagtagaaccttgtcaccaaactccacgtggccagtttcggaatatcagatttatggaccctgatatttttattggaccagagtgtgggtatcagtcccggaaccccacctgctcagctcattttctcttaaatggagtttccgaggcaccaaggagtttcttgtttacactggcggtaaccttagggcgtacctgcgtcggacacgtggattttacgtgcgaactcatgcgtgagaaacaaagaccatgacagctctctcaagtgctcatcttcttcccagttgtccatatctggccagtccaacagactgctcggctgaagaggctcctaaaacgcggcccagaacaatagaaaaggcttgtattgatgcaaccaaaaaaaaaagactcgcgtaaagcctacttgagtgaattcaaaagactgctgctactacagtactgccgctaccatgccttgtaattgtatgaggaaatgttcgctcctgagattgtcctcccgtttttaatgtttcaggttcgtgggcatgtcggtttagcccaactctcacacaccctaccccagaaacagtgcatgtataaggatgtctatcaccggggaatatacagaactaaccattattagatattggtaattaacacaagtaacctatggacccctttcacatacaatgtaccagtacttgcacactgtacctcggttcactgtcctctttaggttcctccaccactctggtcgcaattctcgcgttgatggtaaacaactcaagtacgatctctattttgggttgtctgctccatctttggagcatttatactgtacgactaccgaatgtagctaccactgagtatgcctaaccatctcgttaagatgtgtaccattgaggtataacgacaagtgaagaacatacagagctgctgttgtaaggtgaggtccgaacttgctgattacgcgctcaaatgacactgagacagggggaacaaagcgcccctcaaacttttttcaatgagggtattacattagggcctgatccggtatcattattgcgaattatgaacgtgcttacagagagataacagacgctgcagctccattacccgtgagtatcgctatgcgatgagagctgcatgccaagagctgttggaggcccctatacgaaactgacataatattgggagtgtggcgtgccatacagtagctacacctaagtaatagatacaagaagcatgggatcccgctgtttctcaattctcaactaatggccaaaaaaagcttcctcgatcatatcgattcttccccgtctcatctacgcacagtgcccaattcaaatataaaatagcataggtgtatatactctactcgtgcagacgataagagcaataaaaccagtacatcggtaggttcttagtggactctctggagtccgctttcctcaggtctccaccactcttcatccagagcatcccaggtctcctgggcaagctcctgagctcgctcagtggaggcggccttagcatcaatgtaaatcttgagcttgggctcagttccactacctcgagcagtgaatctaataaactcatcggggttatcgtgagtggccagagtggcagtgatcatctcagtagatggagaaacaggaagagtgggcttgtggtcaggagtggtggagtcgtaaccagtggtaagatctctccagctggtcacatcaaagggaccaatggtcttggggtagtcgcccttctgaaatctacctttgaagtaggatcgaacatgcttgaatgcttcagtggtgagctcaggagtcttggcaatatagtagccgttcttctcagcaaaatggccgtatttgtcatagagagagttgagcttctcaataagcttggcgcctcctccataggcctgagccagctgaaggaagacgagtgacgcgctcacgccgtccttgtcatgtacaccggggaacatatatccaatagcctcctcgtaggcaaagggcacagtgtagccctccttctcgagatcaatagctcggtttccgatccacttgaagccagtaagagtatcttcatacaggaagccctccttctcagccatgaatttcagcatctgagaagagactgtggagttgagcatcgcaatcttcttgccagagttcttgtactgatcccactggtaagcagaaaacaggataccaatctggtttccagtgagctgcacccacttatctccgttctccttgacagcaacagcgaatcggtcagcatcgggatcgttagcaacaatgagatcagccccctgagcatcaccgagtttcatagcgagatcgagcgcgccgtgctcttcggggttagggaatgctactgtggggaaatcggggttgggctcctgctgctttcgaacagagaaaacatcttccagaggaatgccaaagagcttgaatgcctcaatagaaggcaggtagccgacaccatgcatggcagtgtagacgacacccgaagccagagggccggagggctcaaacttgtggtgcaccaggttctttaggttgtcgttatacttttgctgcatctctgttcggttgtcgatagtctctccctcaatgagcttgtccaactttgacaggtcccattcaaacttggtggtcttgtcagcgagagcgtcaatctcggcggcaatgccagtatcatggggagggataatctggcatccgtttccccagtagaccttgtagccgttgtcagccgcggggttgtgggatgcggtcaccatgacaccacaagaggctccaagggcatcaatggcgaaaggaacgatgggtgtgtggacaaggcccttgaacaggtacaccttgaagcccttgttgacgaaggccagggctgtgagcttggcaaactgttcggagttgtgccgatgatcatggccaatgaccacacccttggaggtggcgtcggggacttctcgatctacgtaggaggcgagtccaatagaggcctgcaaaacggtcacgtcattcattcgcgcgaatccagcctccattcgagcacgaagtccagcagttccaaatgagatccgcttgctgagcagagtctccagctgcttggtgtcattggcggtctgcagatcctcaatctgctttcgggtgacggggttctggtcgagatcaagccattgctttactagagtggttgtcattttgatagttgttctgttgttcgtaagtggaagctttcagaacgactgcaaggttcgataatggatcgatgcatctcccaggttgtgagtattgaacccaaatttcggcacttccgtaggtcccaaatgaaagggcttaaaagagggcatgggcctcgtagaaccagtgacactcgacatcgaagccgaccgagctctcaatcgatgttcactgacctagccatgacggcattttctcgattttgtcgctaagctgcaactactggaccggtaccgattcttgtacaacttcacactgagaacttcttagtcatctcaagaacgcacataactacaagtcgctaattaaaaaacaaacaaacggaaacactgttctcattacggtatccttggtaacacttcaatacaacatctcaagactcagaaccaacgataatgcacctctgcttcttccgttgccactcttcaataaatctcagcgtcaactgcaagaagactccacaaccaccaaggaaccgcagaaaacattaaagtcggttacagtacatactgtgtagatctctcccctgtcccactctcacactcactttaaagtgtgcttcactctgcgcgactgagcaaataagacgaccattgcgagcacatttacaagccatgagcaaattagtgcgcaaattgaagatttatatataagcctgactggcccttggcctgtgcacattccagaacacatattacacatgatacctgcaactgcgcttcttggccacatttcgacttgaccctgccaagatcactgcacaccaacatcatcacatcatgattgtgatacccccgcaaagtaagattccctacatgtatacaagcacatgacgataccattggacctggtggtggccctacattctctcacacacaacagcctgtaagtgtctactgtacatgctgtgacatcacacacatctcggattagaacagcaagtgtttcattttttcatggtcatctatctgagtcattacatacataaattagagaagagcagcggcggcgaaaatggcggcaccaccgacaacaatctgagaaacaccagagataccagcaccgttggcgttggcagcagcagttccagaaggcttgccagaagcggtgtggttggaggtggagtttccaccagcaactgcggagcccttcttgagctcaatgttagcgcaagcaagtcgggaagtgttgggggcatggataacgacggagacgttgccgaggaaagcaccaatgccgtccttagtggaagcgtagagctcggtgtactcagtgtggaagtgggtggtggaaccgttggctgaggggatcttgccgtgcttgccggaaaggtcaccaacctcacaagtctctggcttggaggcgtcacactcaggcttctgacctcgctggtaggggtcaaggtgagccaaagtggcggcgcaggagccgttggcgggaacgggcagggcgtggatgtggtaagggtagggaccctcgacgccgtcgaacttaccctcaaggtcgaccgagacatcaacaccggttccgttcttagcagcagtgaaggtgatctttcccttaacggttccctccttgtcaaaaacgacctcgtagacttcgccaacggggttgtcgttgatgatggcagcatcgccgagcttgccggtgacaccgtcggtggtgttcttctgggccagagcagcggcggccagggtggagacgacaacagacttgaaaagcatttgtgtaatgtgcgaaagctatgtaaggaaagaaaaactaagatggggggggcaaagtaggtatttaagtagacagcgacagaacacaaaaggacgatcgatcttcccaagatgaatgtctgtgttcccttattaggcatgggcgtattattagacttccgtctagccttggctaaggtaccgtgcatgggatgctgtacacggaggagcttacatggttatattcaggggcgaacagatctgagtaagtaaaatagtcacgatacttcagggtgttggtattttcatcgtatttactagcagatctcaatgaatgtgtttttgataatagtctgtcttgtgtgggaacatcgattaccaccagatgaaccgaaatgtatgtgtagcctcacatctgcatgcgttgattgaaagtctaaagaaacgtgaaagcagagaaagaaaggcatcggggtaaaaagtgtcggtgggtccgtgtatccaaaaccatacaagacagctgcgaaagttggggttgtaggtatatatgtcgactctgtagttgttgtagatagaaggatgacgcgataccttcattacgaataccaattacacccacaaacagtgctgtttctcctggaatgcgttatttttccttcctgggaatgattatcagatgcggttgtgttgatttctcgtgtgggatgcacaatgatgcgattgacaaccgaaaaagacaaaacgagtgagaaagaattacaaggaaattacggtaggcgcggaaagaaaaaaatcgatcgctaagttgagaagacgggtagaacgcagattcaattggccagataagactgttgttttgaaacatccccgcccaccgccgtgtaagtgtactccagatgcagctacaataacacactacctgttaaaacgcgagaaactggaaccaatcagtggtgcaccttgctatgtgaaagcctccatattttttctgcaggcatacaaaggggcacactcttttcgggcgcgggtcttgagacaagcgtgccaccaggtaccaaactctcagcgccccttcttggcaattgaccagcagaattcatggctcggcaatgcctacagccgttgttggggaccgttctcaagagtgacagagatgtagttcgcgggggttcgaaaatagctctaaaggttcctgaccttggtggccctaatgaccattgcattaaagagaaggccgaggatctactcgtagctttcagggcaggtgaaaaagccaacctccacggtttgcatttaatcagataaatcaacattagaaagatcagcaggaagcgtgtactagggtccaaactttgcgaggaagcgtttttattgggtcaaaactgttacctccacagattgaagatctcggctcttcggactgcagttaacgcgacatgatttttagaacttcactgttacttgtagcgtattgttggtactgcaacaatgttccgagactgatgcaaaccgctggaaccagcaggcctaacgtagtgtgactcatggcaggatttcctcaattgaagatctacgagtacgagctccgtccaaggttccgatggagtctcagtttgttcagcggaagcgagaaacgaggaaacgagcagcaagcaacaaacgctcacagctctcgagcatactggcgcatgtgccgtgtatacggggagagtcgcatataaggggtctgatgcaacgccaaatgagaattcttacaagaatgcgttgacgtcaaaagcgctgcccacctacaagtagtccatggacaaaggtctggacactgcggttcacggtggctaatattatggctttcacaccagcttgtgcaatgactgtttacctcacggtttgagtctgagtcaatggttagaggaatacggcggcaaaccctccccctcggcatgagcctgaggggaacaagagataggcagtcataaacccagccttgtgtcaaaacatcaactataagaaccggttttttccttggccgatgttcctgggttgctacaagacggagaatagcaggttatatggctatacactaacaagagcgtctctttaacgcttcaatcttatgcagtgtcgaaactgttccttgatgacgatcctcggaggaggcaacaagcgcctatgggtcgttacccggacgcgagcactcgtacaataccagcacatactgtaaacgacactctaactttcgagagaccgagcttttggcttccagttacccggaccacctgcacacgtacacacggtgtgtgggtggttttggagttaccgatcatagccgggccgtggaatataaagcaggttgtcttaccagaatgagggacggcttgaaaggtgggtaaacgaaagttttagacagcgacacaagaggtggaggtctgcgttttataaaacaaaggaaaggaggcatggatccactgttttgataccttatcagggcgactaagagattatccagatatgagcacctctgctattgcgcctccacctttctgacgtgcgctatcacggtcgtatcgctctagccaagctcgtttggacaactccgatatcgccagtggagacatctaagctttgtcagggccttccgcgctttttacacaggactcggctttaaatgtcatgtgatgtacgatacagtatttttaggtagacattggagatgcgagcacaacggtatatgttggctacttgtagtggtgtcagccctggcattcctcctttaaagctcacttatcacggctcccatgtatgctgtacctcggcatgcttacaaatttgccacatgttagtaatatatccttacggtgaacgttgtcagaggtgactaattgacccattctgccgcttagctgtaggtgttctcgaacattcatctaatggcgtgataaactcaactgaccaaatggtgactgaggggatgtaataacaagagacgcttactgatccgcaatatatatatgtgacaccacatattttctccttcgtcgtcaagaccacacttgtctcatcacagatcagcatttagagtggataacgacgcagagaaagacccccaccaagcggtagactgttgtcccaacgcagcatctgaaaaataaccgtaaccgcgctttcccatatcacctaatccaaccccagattccgcaggatcagacattacaacttactcaacaccaccgcgaaacactcgaggactaagaaacaggcccagcatcaccggcactaccgaaatattcctggaatcggcgctagattgtgatactccatctcaaattactcgactcacttgccaagccaccgactcggactatactccacacttcggcagttgaacggcataacccccgaaatcaaaatcagcaagaatactgctgataattacagagactactttcctgcatacacctcatgagcaagcctattgatattcccgatacctccgaagaggtgtcgcagatcgatctcgtttcgcccactttcacgccaacggagtctcaggtgggaacccccgacgctatccccgtcacagaagaagagtcgggagcaccagtactcaagctctcggccacactcccagaggtcgagtgtctggtgcgagccagaatccccaccaccaacggaaccgagatcttccttcatctgtacaccaacaatgtcgacaagaaggaacatctggctattgttttcggaaaccacatcagatcaaagtctttggaccggccacgagaaggcgagactgagatggacagaatgacccgaggggcttacacaggccgactcttccctggaagacagtcttccaaggaaggagtcccctccacccgaaccccagagcccgcttccaaggctccagacacgaccctggtgcgaatccactccgagtgctacactggtgagacagcctggtctgcccggtgtgactgtggagagcagcttgacgaggcagccaggcttatgggaaacaaaaactccggtgtcattgtctacctgcgacaggagggacgaggaatcggtctgggggagaagctcaaggcatacaacttgcaggatctcggtgctgacactgtacaggccaacctgatgctcaaacatcccgctgatggtcgagactttggcctggcaactgctattctgcaggatctggaccagactaagatccagctgctcaccaataaccccgacaagattgccgcagttgagggacctaacaaggaggtcaccgtggtggaacgtgtacccatggttcctctggcctggaaggacaagtccaagggtattcacagcgacgaggtggacggctacctccggaccaagattgagcgtatgggacatcttctcagcgaacccatggcaaaataagactgtttgtactatatgtttccagtcgttcctaagcatgaataattttgcatatgttcatcgtgcaagctacagtaggaacggctcaagaataacgaaggatgtttcaagtcacctgtttgtgatgggatcatcgtagttatgtatttaagatgatgacaatgactgtaatgggtgggtaatagagtaagtcgttcttgtagagtagttgtttgtattgtagaaatggttaatagagaccatcaagtgaacctgtgaaccaggctttatgcgattcatactgcagtgaaccacatgggaggcgtgacggatactttctacttgagactctttagacgtgcaaaaaaacataacacagtaatttcacaattcggcgcatcctacgagtaatacacttgtatatattcgtacaatgtacagtacatactgtacagtatgtatactgtgcccagtggctacccgttgtcacctcctacaaagtctggtctgaaacacaatccatcccatccatgcatccttgtaattatgcagaaaggcggggcaataacactttcgcatgtgattaaaagggtatggtcaaggcaaagcgtcatcgcaatctccaatcacctcaatcatattcctactctgtatactctatcacaccctctatgaatagacactctttacggcgcttggagtgcatgtagtctatctccgctctttctaagtcagcatcggtgatatcggagaattggttgatagcaacttccgcaaggaacagattcaaaacagacgactgcgcaatttatactgtagctatccacttccaaagggcttcaacctgtggctcccgtatatgggttgtcatggtcttcaatggtttaccaaccccagcaactcactgtaactactttacagtaagtgttagttctgaaccggtacgggctgtggggagggtcacgagagaatgccattttttgctttgtctaactattacaaatgctcctaattctccaggagataaggggggtctaggccacgcagttaagacgctgccaccggttgtttttgccaggcaacagtggcccgcagctctcggttcgggtagctgcacagtgccgttattcgccgctcgtattcattaataatacgaggtctgcaggcaagttgaaccgatgttttgggggtttaggagggccacttgaccctttaacccttgctctgagcatttagcctgctctctctctcccaatgcaatgcttacagttgtgaagcctatttcgtggcggacccttaacacagtaccgccagccgcatctataaagagaaccatcagtgctcttcaattccacctcagacaccccagtcttcctttcaatcgacttcgaacaacacacacaatgtccgccgagaaaaccaataccgctttctacaacctcgctccactcgacaagaacggagagcctttccccttcaagcagcttgagggcaaggtcgtgctcatcgtgaacgtcgcctccaagtgtggctttactccccaatacaagggccttgaggaggtctaccagaagtacaaggatcagggattcaccatcatcggcttcccctgcaaccagtttggtggccaagagcctggttccgctgacgagatctcctccttctgtcagctgaactacggcgtcactttccccgttcttcagaagatcaacgtcaacggcaacgacgccgaccccgtctacgtctacctgaaggagcagaaggctggtctgctgggcttccgaggaatcaagtggaactttgagaagttcctggttgataagcacggtaacgtcgtcgaccgatatgcttccctcaagacccccgccggcctcgaatccaccatcgagaccctcctcaaaaagccctaagcgtgctgaggctctacaatcgcaagaggactcgtgttcgatccgtgtgtcacatacatagcaactaatcaagtaatttaacactatcatttgtaaccgttgaagggtgtagacagaagccggatatccctcagctacatactactcgtagaagtaggagtctcaagtacttgtacttatagataaatactcgtgctttttctctttttcactcattgcaacattccctcgtatcacttgctacaagtacaggtacttcctgctatggtcacaccattcatttattgggtttagcgccagggcagcaccgttgggttgcatggtattagtattaatatattcagaggctatcaccgagaacggtagcaacaaaaacataacgaggaatttattccctgcaacctatcctgcaacctacccaaaggcattctaatttaaatacattcatacatataatatacccgtcgcatgccctacgccttcttcttcttggcagactttttgggagtctcgacgtcgggggtggaagacgattttcgcttctcgccagcaccatcgtactctttaccaacgtaagaaagcagagtctggcctcgtcgcgcaagctctgcaggagtcctcgacaggaagaaccagtcgaatcggaacacgggtgatgctcgaatggcgtctcggatcatctcataaacaccctcagtctcaaggccgtacctgtagagttgaaccagaatataccgatcctcgtcctcagagtagattttcttctggcctgcagggtagacaatgaccatctgctgtagaggggcctcatagccctccacctttcgggttagaagagtgttttgatggttctgcttcttggccttgtcctcacctgcctcgatctgctgaatgtatctgtcaaagccgttgatctcagtgtatcgttgccagaacacgccagcgtacttcttgatatcggcttgggtcttgtcctcgaactctgtggcaatggcagcaaagttgtttcgaccatgacgcgccgaagcctggatgaaatttgtgaaatctcgtcggttccagttggagaaacccttagtggacaggtctaccttctcctcctcttcctcctcggtgagaggctcggcgttgtcaatctcctgctgctcaagatctcgctcgctctctcgcatctcaagctcttcttcagctccatcgggaagaggcaccttgtaaccaatttgctttcggtagtaagaagtctccttctcctgaatgtcgataagtcgctgggggtagaactgatggtcctggatgttcagctgcttgggggccttgggggccttgggcgcagcgttcttgcccgcagcagcgccctggttaagcatttctcggtagtacgagtcgatggagtagttttcctttcgctcacgcttgttgggtgcaatccacacgaagggcttgttagtcttgctggtgtccttcttcttgaaatcctctccgttccattcgtaggcagaatcggaagtgaacttttgcagatcatcaagaccaagagagtcgtaacgggagttgagctccatagtcttctgctggcctcgcttgagaatgtcgtcaatatcaagatcagcctcctcctgttcctcgccctttcctcggttgaacaccttctcggcaccaaattgaatcatattaagcagatcatccttgttctgggcgttgttgttgactttggattgcgatcggccttgctgaataaccagcttgtccagacgcagcttctgtgtagctcgctcgatgaccttctcctcgacagcgttttcagtaatgaatcggtagacataaacctgcttggtttgtccaattcgatgagctcgatccatggcctgaagatcagcttgagggttccagtcagagtcgtaaaggacaacttggtcggcagtagtcaaattgataccgagaccaccagctcgagttgtcagcaagaacacaaacttctcggatccctccttgttgtaggcatcaatggcgttgattcggtcctcatgcgcagtctgaccatcaattcgacaatacttgtaacctcggaacagacagtaatcctcaagaatatcaaggactcgactcatctgggagaagataagaacacgagatccctgctcctgaattcgcttcagaagcttgtcgagaatcaccatcttgccagcattgtagacaagatgctcatcagtggtgtaaggaggtccaggctcggcaccctcgaacaaatagggatggttgcagcactttcgcagctgcatcacaatgttgagaagccgggttttgccctcacgcttgccaatctgaccgttgacagcgtcaatgtccttctcgagaattttctggtaccatttaacctgcatgtcggacatgccaacgtagaggttgatctccttcttgggcaaaagagacttctcgacatcggccttgactcgtcggagtaggaatggccgcagaatcttatgcagctggttcacggctgcgtcctggtctccactctggtcttcaccgaaccaggcatcaaaagccgcagagtcctggaacacgtcggggagaatatagttcagaagagcccacagctcgtgcaggttgttttgcaaaggagtaccggtgatcaacagtcggttttcggtgtggaacagacggatgatctgtgacagagaagactcctcgttcttgattcgatgagcctcatcaatcacaatgtattgccaagcaaaccgtcgcagatatcccttctctcgaagaaccatctcgtaggaggtaatgcatacgtcaaagtcgcaggtcagaagccgatcctggataagctgagctcggccctccttgtctccctgaagaacaagaacgttgacctcaggagtccatttggcaaactctcgggcccagttgtccagggtagacttgggaacacagaccaaatgaggaccgggaattccacggaagtatcgaaggtatcccaggaaagagatggtctgcagagtcttaccaagacccatttcgtcggccagaatgccagaaagaccatgctcataaagagagaccatccagttgaggccctgaacttggtactctcgcagagttccctgaatgtagccaggagaagtctcgaagacggtttcgaccgagttctcggcctcctcctctccctgcatcagctcagcgtcttcttccttctcggtctttctgtgtcgcgcgccaccggtgggtttctcggtggtcttgttaagaccgagctcctcctttgcctgttccatggcctttctgtaattggggtcggactctcccttggacttcaggaagtactcaaaaacgtcgctcagcccgtaaagatgtttgattttcttgacgagttcgggaatggacttctgcttgggcttaccaagacccttgtcgggaagcagatagcccgatcggatgttgagcagatcttcggtcgacagctggactggaggcgtgtccctgtttggggtcgtcacggtggaaaccatggaagactggggttagtaaaagtcgtgatgagaggatcaaggggcagttttgcaacggtactcactcctggattggacttatccaagtctatgggtgctggtccagacattgttgatgtatgttgcaagtcgcgcgaagtccacgtttctacgcagaaaagttgcttgtcggtgaggatagggtttcgtcgcgcgtagcagttggtacactaattactgggagcccggaaatgggcatgtatggaaaagagactggtgacgtttgagggcaatataatagtatcagctaatatacatatggctcaagggggaaacatgagcgtgtcaggaaaaaaaaattatttcgaacctccccatctatcagctctgtcatcttctctcatcgttatggcacgtgaagttttcctgcccctacgtaaagatgcagtccaatgttccaactgctacaagtaggtctaaaagagaggtgatcaaccttcccaacaggacaagattaatacaatagttttacatatggtacaccctcgttgacactacaaggtcaattataccgtgttgtacattcaactgtacagacattagcttagctaattgtactgtagctagtccaaagctattaatcaccctcttctccttctatgtcccatgtattcattaagttgatccgtctatatatgtaaaatgactccctgtccgtcctgaaacaaatacgatacactactcgggccgtattctacgcccaccatagcgtatatcccttctctgtagtcttagatgttatccagctcatcccacagatcttgaggaatgtcttcctttctcatcatacgagaatcgagaatcttgtctccgctgccgggaagtcggatctcgtgtgtgccctcggctatcgcgtccagctgcttggtctctggagtttctgctgggatcatgaagttgttgtcgcagtaaggacaaaagctgtctgcttcgtcaaagtccgtgagatcttttcggaacgcctttcgacactttttgcatgcaaaggtcatttctgtcgtctttcgaagtgggtggtcttcggcttcctcgtggcctgtgttagcagtcaaatatcaaagccgttgtcatccgttgttagacaccaggatctcgtgctccagctggcgcattatctccctgtgaccaaccccctgaatagtccgtcacctattcatgttccacgtcgatactcacactgtggacagtcataccactttcgacagcattgtgttcggattgagacttgggcgttagtaatatgcttgcacatggtgggtgggtcgagatgtgtgaaatgcagaaagagcaagatccgtgtcttttagatgtgttttggtgttttctatggacccttccagaagatcacgttgtagagttgcgaggcgcgtggtgattagattactcatgtgatcagaactgtaaccttaattcaatgtatatcgccaccttgcaaaactggagattcatgatacacggggattatacagcatgacatatggttagtctgtagtatctagcttaccagtttgttgatatacgtattctcaactccgtgtttggctgtcacttcacaacttatggaaaagagattgaagatgggtactaaacctaattgacaaaccttcgggaacagtactgaaaaccattgctaatagagttccagttcgttcaagtgagattgggtatatgaaagtgagcgaggaacacatctctcagctcacttttcaaaccacacacccagagcatgccgtcgctagttgatcccgtggcaaacaaaaccgacgagggaaataaccggacggatctgaaggcccccgagcctgagcactgtccaggaacagagtcagaggaagctggaaaggctgacgcttgtcaaggatgccctaaccaagacatctgtgcatcagcacccaagggacccgatcctgatcttccgctcatcaaggaccgaatgaagggagtgaagcacaagattctggtgctttcaggaaagggtggagttggaaagagcacattctcttcgctccttggctggggctttgcctcggatctggacagagaagtgggactcatggacattgatatttgcggaccctcgctacccaaaatgatgggaagtgaaggcgaacaaattcacacctcactttcagggtggtcacccatctatgtgtcagataacctgggcatgatgagtgtgggcttcatgctgcccaaccaggacgacgctatcatctggagaggcgccaagaaaaatggacttattaaacaatttctgaaggacgttgactggggtaatttggactatctcgttgtggatacgccccctggtacttctgatgaacatctttcagtcactcagtacctgaaagagtctggcgttgatggtgcagtcgtaatcaccacgccccaggaggttgcattgttggatgttcgaaaggagcttgacttctgccgaaagtcaggtatcaagatcatcggactggtcgagaacatgtccggattcgtgtgtcccaactgtaagggtgagagtttcattttcgcccctactacaggaggaggaaaggcgctggcggaggaattcaacataccgtttcttggtagtgtccctctcgatcctcgaatcggaaaatcatgtgatcatggagaaagttttgtggaggagtaccccgactctcctgcgaccaccgccattctggacgtcatcaggcagattagagaggctgtgggagaccctcaagaggacgaggacgatgacatggatgagtaaactcgcattttagatatgacctatttataaatatatgactgtaacgtgaataattaatgtgaataaatatataaactatcatctatagtcagaaaacttgaccagaagttcatccacacctgcagcagcatcacctctagcgagacgctcttgttggacatcggagaacatcgccaagagccgtagtgctagcaccttgacattgctaagcttgtctgtgtcgatattaatatcctcctgatccttgaaggtccgagacacttcggcgtagatctgagtgcaggcaatgaggaactgtttaaaggtatttacaatttctctgttgttgagattgagaaggtcgtatagtccgtatgcaaaggactccagttccgctgagattttggcgagaatgtcagagtcatgattatcattaacctgtgccacaatcacaagcttttcgaaacgcaagtcaatgaggtcagcttggacatgtgcccagtatgactccagaaagtagtagacaaaggcgagggactcccagagaatgaaatcagacgatctcgacctcgaatagtacacccttcgttgtctccataaatcgttgagttgtaagatggtcttccggatcgccagaagcatgtcaaagattgcactcagcgaaggcatgacagatggggacacaatgattgtaacaggccatctaagtctgtatctcagcttgtaatgatatcctgtcacaaagtctgagaatgaagacgtatatgaagtggacttcttgtaagacagatactttgggactgaagccaagaactcgttgtgtttctcatcaataagatagtttaacgctgcagagaacgctatgcttccgttcttcttctgttccagtgcatccaaaaagaccatactgaattcgccgtcacccagaagataaatgcctctaaacagagtgagtagtttttggacctcggcagtaggcaggatagaatcaagaaggttagagtagacttgtttctttgtgtatctgatcaactcctcaatggcgagcgtcttcatgggaaaggccattgtcttctcagagtacccacagatgcttttagctagtttaccgacggatttcagcatctcagtatcgttgttattgcttgcctgggcaatcagcatccccaccgacaaggcatcattagtagactgttcagagataggatgtaaaaagcttcccttgacaatctcgtactcagctgtcacttcatccctgtccagatcggcaacagggagcaccatgaagtcatgagcagcggaaaaagaagaaggcagctttccgtaaaggagccatctgctaaattgtcttaaccagcatttctccagtgcgatgatgcactcctggaccaagttttgcaagtccgggtagcccacctgaacgtctgattgaagtctgctgtaaattgttgatcctgaaacgaacggaaaagtagacaggtcattggggtcgactgctctgcggtcttcttcagaaaggtccgagaagtagaagaagtcgagcagctcgtgagtatattccaatcgtctggtccatggtgatgtgattttgagctgaatctgagacaaaggaatcgtttccgctgcccctccagtacttgtgtaggtaacgtctcctcctaggagtctcttttccagatcagctagttccatcaggtattttctcaccactcttcgttccagaacctcaacaaccgcctggcaacacggcgtgaacgccaccgaaataccagcttctcttcttgataatgccgaagttgcatacattgttgacttgacccgctcgtcaatggaggaaaatagtctcccacattctgcaaactggttgagtagttgacgttcagctgtatggagggtcctgtgccacgaattttccagtccgtcgagcacagatgatgtcaccagtggagaaatgttgcctgctaaaacaagcaatatctcatgggacatggtggtcttgttatcgtaatgtcgtgagttgattgatgctcctgtttgaaaacagagtttgatggtggtcgcgactacgcgtcttcatgcagtgttttttttttctcatatacattcagttaaaattccaagtaaagctacagtaattaacttacactactactgtaagaaatatttaacaaatctattgggtgaattcgtcacagcaatatcaggttattataaaaaaaaaataggcaagtcttactctacaatgagacatctgctagtcttctcttattcattagagtttaatgtatttttgttataatataaaaacacagcagacatccattgtttgaggatctgtggaaaatgaaagttgatttgctgtcaataaatttacaagaacttatgggtttcaggtggtgtattttattgtaccatgttgttgctgtttaaacatcttacttatattaatctactttatctatcaaagagccccctgggcagcggcacgctcatggatagaccctgacgctcgagggatgaaggagtgggtctcggatttctgagcttcctcggccttggaagacttgtcctccttgacatggccatatccacctccaccaggggtctggatgataattcgctcaccaggagacatccgaaccgtattcttacctccaagagtggcagttgtaccgttctttcgaacccacagattcataccgggtttgccagactcgccacccttcatcccataaggtgctgaagatcgacgttcagacaaaatgctgcattggacaggttgagtgaactggatgtcacgaacaacaccgtttcctccggtgaactctccagctcctccacttccacgtcgaacactgaactcgcggaggatagcggggtatcgtttctcgaagatctcaggatctgtggaccgggtgttggtcatgtgcacctgaacaccactctgaccattccaagtgggaccagcacccgctcctccagcaatggtctcgtagtaaccaaaggtctcggtggcagtacattccttgtccttcagcatctgaggggaaataccaaaggttaagttgttacaggtaccctgggaagcgcccatggcctcgaatgccttcagaacaacgtcggtaactcgctgagaagtctcgacattacctccaacagtggcagcatcagcggaaggagccagcactgtgttgttggggataaaaatttcaatgggtttaagacaaccaccattgaggggaatgtcagcatcaatgagagatcgcagaacgtacagaatggcactgtatgtgacactcttgggtgcattcaggttgccgtacacctgaggaccagtcccagagaagtcgaatctggcagatccatcgtccgcgatcgtgatggtgagaacaatgggagttccctcgtcaagctggtcacgtgcggtgaacacggtggtctccctcttctctcgagctccgataagaagctttcgaacagcctcttcggcattctgctgaatggccttcatgtacttctggacgacgttgagaccgaagtcctcaatcagagcctcaatcagacgaatacccttgttgttggcagcgatttgagcctgtagatcactaagagagtcctgaagagaccgagatccctcacaacccggatacttggaaggctcgtcaaatagcagacgaaccattccggcttcgtcatatttgcccttggagacgaccttgaaagcctggatagtggctccctcttcccacaactccttggagaatggaggcatagagccagcagagatacctccgatgtcggaatggtggccacgggaagcgcagaagaaagcaaccttgcccgtctcatcaaacacgggagtcacaactgtgatgtctggaagatgagaccctccgtaagcagggtgattgcaaaccagaacatctccttcgtggagatcacccttccagtgctcaacctggtatcgcacggccgagctcattgatcccaggtggacagggatatgaggagcgttggcaacaagatcaccatcctggtcgaacagggcacacgagaaatccagccgctccttgatgtttgtagatatggcagtcttctgcagcgtctggcccatctgctcagcaatggacatgaatcgatgggagaagatggacaattccacaagatcgatatggtctccagaatcaatctccttgacggtttcatccagctcaattatcacatggttgtccaagacagtggctttgccattggaggcgaccaccagagtctgggtcgcgtcaatgatgagagcagggcctgcaacctggtcgccagtctgaagatcagcaatcttgaacacacagcagtcgtgccacgattcgtcaaagtacaccttctgggtattagtggccttgggggtagtcacaccgttgctcttggccttggtaagctcctggatggggtgctcaggattgtaaccggtctttccaactgctcggactcgcacatcggccacaagaatatcgcggtcaagtgtgaaaccaaactcctgcttgtggagctcagtaaactgcttcgcgaaagaggtataatccccctcaccctgctgggcaaccatcataagagactcgcttcctctgtatcgcaaattgaggtatttctcgcactccacatcgccctctgtgaatccctggctcataagtgtggcagtagcttccttagcaagaacactaagtctctccttcaattcaccgagagctgtgtcgcccagaatagcatcagcgggttgctgtgtatccacaacaacatccgcaagagccattccgtaagcagaaagaattgaagagtacttgggaatcacgactcgcgagattccaagagactgtgcaacgtcacaagcatgctgccctccagcccctccaaaagagcatagatcatgaccagaagtgatataacccttaccctcagtgagagatcggataggtctgcacatggtctcattggctacctgcaggaatccgagagcgacattatgaggagtcagatcggaaccctgatccttgttgatctcgtctgtgagctcttggaattttttcttaacaatctctgagtccaaaggctcgttctcattaggtccaaaaatgttggggaactgagaaacaactagtcgaccgaggaacaggttggcatctgtgactgtcagaggacctccctttcggtaacaagcgggtcctggatgtgctgaagcactctccggtcccactgcgaagagtccgtttcgccagaagagaatagatccgccaccagctgccactgtagatatatccagctgaggagactggatggtaacctgggcggtagtggtttcaaaaatgtgaggaagagttccggcatatctagaaacatcagtagaagtaccgcccatatcaaagccgagaacaggtttggggttgggcttctgagaatcgtcatatgcagttcgactgaagccaacaacaccaccagcaggacctgacagaatggctttcaagccggagaattggttccagtgggtcaaaccaccgtcactctgcatgaacagaagttttcgtccaacctcatcgagacctcccttgaaacccttgccgaattgagtgatgtatcgtcttgtggtcggagacaggtaggcagaggctgtagcagagttagcacgcgaaaccagcttgatctggggctgcagctcatgcgacactgacacctcgaatccgatatcacgagcccacttggcaaccatctcctcatgctctgtgaaggagtaaccatgcatgaaggcgatagcaagcgaatcgattcctgaagccttgatcttctcgagctctgcaaccacaacagccttgtcgggagtctggaagacgtggtacttctctccggtatctccagttacctcacctgcagcgtccggcacgactctctcgtccacttcgtacacaacctcgtataactttttgagcttcttgacagacagatcgaagatgttgggtcgagcctgttggccaatggtgagaatatccccaaacccctttgtcacgagaaacgccactctgtcaccctttcgttccagcagagcattcgttgccacagtggttcccattctcacactctcaacctcactcaaatcaataggctcgcccttggggatcttctttccgatggccttctcgagaattcgtcgaattccctcagtgggagcatcttcgtagttggccgggtcgacagagagcagtttgagtacaatctcttggtctggacagtgggcatagacgtccgtgaatgttccacctcgatctgggtgttagtagcgtttttggggttgtttctctcagggaatgttattagccaatcaaatgtccccatactcaccgattgcaattctgatgccacccatgtctttagtttgttggtgtattatcgacttttacgatctcacgttccccacagttggttatataccaatagccgtagactgcagatagacaacatgactaaggaatctggccagggacaagcccgggtcgaaccctaaaagtggcaccaactatgcgggggtttagcaggatgggcacgtacagctggggtgaattgatgggggtaatagtccagcatttcctcagtgattgtcgtgtcacgtggtcctattgtttcccaggcaagaaatcaagccacaatcattggcacttacatgttccagttagattgaagtcaaagataagcaatctaaactaccgtatcaagaccaggactatacgcgcgatgcataattgagaaaaagacagggacatggtggggtaaataagtcgactttaggaagatcgcgtttgatccgaagatgatatggagagtccatagttccatagacatattgaacagaccatactggtggtgaacttcacacgttaccatgtacagtaactacagcagacacctctcgttgtcaaccacgaagacaccagattcagtctggtgaaatacatggatcagtacagtacatacagtatatacatctgagcttgaacttcaccccccaccagtaagactttcgggtagccgttcccggcactgcaagctacacgtcagaacttgtacaggcacgcgcgtacggtatgtactgtaatttgtggacactcacactactacttgtagtacaagtatcaaagtctccatttaacaaaatacaacatgacataccggatgtgctacttgtatcattgtactgttacagttataatcaccagaataaaatagttggataagttatttgtaaacatcactcaatcatcgttcatagtctattgttgcaatctactcccatttaccaagagtgggggtagcagcagatcgacggtgtctgaggtagcgcttgcccatcttggcaacggccaggagcacgaaaaccaaaagaatgtacgtcttaagtccccagacgaagatgaaccaagaagcgaagaaccctcgagtgcttcgcgggaagagctgtcgactgttgttcttctcaataagatcaagcacacgggcgagctgctccgcatcagagggttcaagcctggcgttcttatcgtcggtgtcaaagaactgaacgttcttcgcatcatcaatgacgatgataggagcgttagcctttcggtcgtcccagttgaatcggaatcggctctctatccacttggagtacttgtcggcgtcgatccaagcaaactggactggaggtcgggtaggaacagaggtgtcatccttctcgagcttcttctggagcttgggatccttctccttgagcagcttggctcgctcactgtgccgttggattcgcaggagatccaactctttctgtcgagcatgcatcttggccttgaagtacttggtggccgactgcttgagctcatcgatggcaaccttggtggcgaatttgtcttcacggtcgacgagagcaagaacgacgattcggccgtcagcgaaaacagaatcctggttgataggggtcagctcaggcatgagagggagccaagttcgtcgagcaaactgcaggagtcgttcagagtttcgaaggtggccaacatcgtactctgggtagacctcaaaggacatctcatcagtgtagtcattgttgacagcaacaagagcgggaagtcgggtgacagaaaacttgtccaccagcttcttgtcgtcacttttgtagacattggcatgggcgacaacgttaatggcgaacttctgaagagcctgcagatcctcggggaagagggcctcgtcgtgaagatagatgtaagacacggtctcggggtgcttctgtcgaagttcctcgaactcaagctggttgacggacttcatgtctcgagcctcaacggcctgcagaccaaagagggtcagagcatcggtagttcgctcgccgttgtatgtaacagagagctctccgatctggaaagtcacggcgggatagtactcgataccctggcctcggcaaaaatcagcgtacttggcgcagttaatctcaccaacattgagctggttcttgaacttggcagccacctcgttccaagcgtcatccatggcaacacagtgaggacacgagggaaggtagtacttgatgtaccagccagtaggatcatcagaaacaagagccttgaagttggtggggttcaggtcgacagaaagtccctcaacgttcacgttagccttctttgtggaagcgatcttctcctcgtctccctccagcttggagataccggaggcctccttgattttttcctccacaaactttgccagtctgctgggctgtgtcccctttctcagatcgtaagtctctaccttctttccgttcttgtacaggttgagggtggggtagacattgatgttctcctggttacacaagtctccgtcagccagacagttgacagcagcaatgtggaagtcgtgtcgggatgcaacgtcattaccaatttcctggtacattcgttcccactttggtgccagcatctggcagtggccgcattgtggcgaatagaacttgacccagtaggttccctcagctacggtggtctcccattccttgccggaaatctcggggcaaggcgcaggggcctcctcttcaccttcgggtttgggtgtgggaattactgctgcaacagcggcggctgccaacaacagcagtcgtgtgattctcatgtggatgtggcgagtgtggtgtggtgttttcctacacttgaatccgcaagtttaatgacgatgcatgatttttttgaactgcagtcttgggactgtggagatgtttatccgcagctgcagaatggtgagtgctatacttttggtttagtggagagggcaagtatggcaacaaaaatttggtgtgggagttgggacgaaagcgctgtcgaaagaggcgcacgcagacacgtgtacgaattatctcagagtcaatgcagtgagggataaggaaggtccagctttacacgaggcatcacattatgtaatcagaaacaatatactgtaaagtctgagaatccaactcgtcacatttcccaaaccccttattttcttcaaccggagaaacataaagggccctagaatgcgcagctacacggctcacggcccccgaaccttgactatctttgacgcacactttcttattgttcgcaacgccttttagaagcagagaacggttgctgcattgtcacgatttggagagaccgagtgatggttacaacagtgtgtggttcgagttggagtgccgtcgtgcttgactgctgtacagtatgtacaaaccgccctcagttcatttatatctccttctacaatgtatagtttccaccacccatagtttcttatatccgccgcttgtagctacagtacttcaggtggccaattggtatgtcagacatctggtacgcggcacatgttacacgaaacgaagcactgatgttggcttctacagagtggttgcagatgtctggtgcagtagggtgaataagtgattgtatataatatgtgtcggcaccagtacagtagtgtggcccggctttctatgtttgtaatactatacttactctgccttacctacagtacatacatctctaagacgacaattgaatttatccatggcgtctttctacctcctctcacccatactaagacaagacggctgcttgatcttcacgctaaagcccatcattggccaaaagcgaagttgctgctgtacaagagtattgtagctactttcagtccgggcatggttgtaatgttacccattatcttgtgtgtcaatggcgtttcggcacattctatagctccttttagactggcaggggacgagcgacgtaaccaggataacaccggggttatgcacatgccccccactggatatttggaaacagtacggacagcatgttcaatacggtcctaccgggagacatttgttgtcacgtgatggtattgtgaatctgtgcactggtttgtcacccctataccgtagccagtattgtttgtttttggtggaacacctcggtaatgacacccaccaaccaacccatgttttggcgggactctgcttccgggcgtggaggaggacactgcatgaaccctactgtacttgtagtccaaaactggtatactaatgatcaaggtcatgagttgagatgcgggtggaagagatagggggttgaaaattgcaatctttaaagaactgtttgttttagtctgcctgctagctcagtcttctcccatcacaccatcccccagaggttactacccggcattgtggtggaacgagctgaccagctttaagccttccaatttactggctggttaagcgtgactcgcatttcacgcgatgcataaattgaaatgtgctgtagacgatcacacacaacagcccatgtggtaattcgttgaagggttatagcgaagcgaagcattgaattaaagccttttagaggcttctattaatcttgaaaggtgtaatttctcccccgcctcagtttccaataagctgctattgtccaaacgtcacatccattgtcattatcgtcacctcaactctaatacgcgacgcgctacaaccgtgcagacatatctcctggtgggccacacaacatataacttgcacatgtcaactcccacatactaatttacctgcatcgacatattttcacgagaaataccaacttggtactctggcaaaatgtcgacaccgaaccccatgcactcacgaagggccgcccctaccatgaggccgaaaatcaagtgtgagtacacagacaggtgtgaccgactgtttacttgaagtgacaaggtacacgagaaggggtcaacgcgaagaccccggagacacgagtccttctacagacaaacgaccaggacatatgacaagtcaagagaacaagagatggagtcgtcacgcgaggtagcgagccactggtatcgctacatgtgcgctgattttaatgacttgagttgttttgagattgctgcaattgagacgcgggctgttaactacactcaccttgcgactgcctacaagtcactaacccagtaaaacttctatacgaactcaacggaagctcgtgcctggcacgaacacagttccccgtcgatgtgtttgctgccaacgacattgcatttgccaacttcaaacagtgtttcagcgccatcaactctgcgtcaccagaaatcctcgcttctgcttcggaaacagactacgccgtgtacgtggcagactgcaccgaagccgatgagcccatggtgggacgaggtctcctctcacaactcctcgctcgtccggaggtggacatctccgacacttccacgctgctcacaggaggcgttgtttcaggtcgtattacttcatctctgctatctttcatccctggccacgcccaggagactgttgagattcgactccggtttgtcacgatacataaggcgtcccaaattgcatcactcatgtccatgttcttgtactcctcgatccagcagagtctcagcgacgaacaggtctcccagatttgcgatgggcgatggatttccgacctccaagagcagggtatttgggaacagctgctcgagttcaagaactctgtgctggctgaagacgacaaccccactcgacgaattatttcgcccaagaaggccctttcgcctttccagagctcaccaattactgttgcccccgcactgtcagcccccagtgtcaaccccgatgaaggcattcgactcgttggtaaaatttctgaccctcagagtagttcaggtctgctgtcatcctctccctccagacaccaaacaattattcggtcaggtagagctcaggaaatcgacaaggccaaggaacagggccaggttgaaaaggagaatggcaatgagtgttacaactgtcgaacgctgcatgcctccagttggagaaagtgcaccactcatgatgatgatggtgtctttacaatcatactctgcaacccttgtggactttggttcgtcaacaagaaggagcaccgacctagaaagtactggggtaaaatgagagatgggcgccctattcctcccagtaaaagaggtccccgaaagaagtccgataagacgactcttgtcaaggctgagaagaagcccgttctcaagctgcacgataagccccttggcatccagacatccatcgatctaactaacgatgcaagaaagtccacgccttcttcacagaatcccactcccgtgtcatcacacaccatggccccaactcctatgggctctacaccagtaccgagccatcatactcagggacttaaccgaacgcacgtccaggagaacccccatctcaacaagcgacctttccaagcacttactcagagtctgcagcaaccccctgagtttgagagctctcagaccctggccagtaggacagcatctctccctgtatctgacagaggagcaaaacgacataagaccgatgttgcctctcggccttcatgcgacgctgtgcactcagctgctatttataagcctacccagttccaggctgcaacttcatcaccagctgtcaccccaaccatggagtctactgcaacaatgccaagctctcctggcacacagacccggtcaaatagagcttctgcccctggttctcctcctcgaaccaactctgcctcttccagtacccccttccttcagccgaaggcgttgcccccgcttccacctattactccccaaaaagtcagactcacacccagcaaaaaagacaagaccccagactttctggtaggtctttctccatcccgatggctgtcggcttaccttggctcgtcgagatctccttctcagttctcaagccacacctcccccgttgatcacaacactgttaacttcttcagtgaaagtgatctgttcacggagtctcccttcagagggctctaccagggcgtgcgatcagagccgttcacacaaagcacagctgggagcatgccccctccctcggctgatgacgactacaacatgaacgtgctgccttcatctccatcaatcttccgaatgtacaaagacaacagcgacttgttctcctcaagcagccaatccaccgaggccacttcccccatcaacaagcttcaacagattgctcgaaactcccccgacgcgcacaagagcctggaggagtctgaggaaattggaaatactaacaagaccaataaggcctagatgatcggaataatctaacaagccgcatagcattagcatttatttataatatattgtatcaatataattactcaaccctcaaatatgtcgttaccaatatattatagctacttgtatgtatgtacatactacagtagaagtacgtacagtacgaaataagtagactataaattcccctagggcgcatgttcatacttgtgctgtacaatatgtaatatgtaactacagtacttgtagttgctgtaaaaaaaaatcctgatatatctcgttgttgtaaatcattcattagtcagtctatttaactacaagtagcgaggcagcgactgtaagtccctagaataaacaaaggtcacacatgggtttccaggagcgttgcgcctgtaagcttacgtcatctatacacgaattgtcgctggaaaggaaagagccgctgccccatatatggggcagcgtacgtaagtgagtgagggtagagagcttccacccttaaataaccccaaacaggcagcccgcatccttggcggtggttttaccccagtcttcagtcctcctccaacctttctttatgtgtgtgcctttagagaaccctataataggtatgcagtgaggagtgcaagtaggccctcctctgtatccaggaggttagcgtcggttagctccccagcctctgcccctaaaacgacgcgggcctactccctcaggtgacactctctcaggatattcatcccaataaaataatagctgtttgataaaaaggaaatgttaatgcaaaaaaaaccatcattgaatgttggatatgggaaaaaaaccagacgacctcggagagggtcgaactctcgatcttacgatggcggccatttaggtgactaacagtcgtacgccttaaccaacttggccacgaagtctggacgatgtcttggtaggatgcgatgaagtatctaactttaatctcagatcacgtgaggattagaataaaaaaaaattttgattcaccaccacgagaccacgacaaagacaagaacgagacgaagcgtcgacaaaccaactgacatgcgcctcgcagcgcacaccacaatgattcagaagtgtatgatttattgaacgccaataacccggcttactacttgtaggtatatagctgtaatgaatcattagaataaaaaaaaaaaaaaaaaaaaaaacaccctgaaaaatatagagaggaaaatgcgaaaaagataaatcggttttgatgaaatccagaaatgcataatgggcacaaagaagaaagatgtgatgataatcatacagtatttgtaagtgactcatatctgtacttgtacctatatcttggttacaacataggtgggtgatttcttctcgcccagttgcatcaatgtctttaaagctctataacatgcgcgtgagggtacaagtatatgtgaggttcgtcgatgtagggtaaccgacgaacgtaaagaagagatgaaaagcgagggggcttaactgatagcgggttgctcgtgtacacaggagcgtcgtagttgagggtcacagccctttcggaggagccaagagcttcctgttctaaaagtcaaagacacaaataaaacggggaaaacaagctgcattctaaactatagaaaactggtgattatatacacaaaccaaataaggtttgttggggataatatgtcaccggagtaacgtaactacacaggctagggagatagcttacatatatactgtacggttgtgtcacacccaactccccagagcactatcaggaatacccaataacaaatgcagtaacttgtagtctttattggtgttaataaataatctcacttagaaaacttgaaggcggtttcgtcttcgctatcatcatcgatagttattgcagcatgagatgtctgaacctccgactcctcttcaggctcggagtctttcaagaacaggtcgtcatcatcagcctcctcagcaccatcctctccatcatcatccaatgcccgatacttcttctgaggctcgcctctttcgcgtagaattcggattcttctgtccgtcaagttttcccctgcatggagcatgtcatcgattgatgtttgatcagattgcgcaggtttatcaggaaccagtgccacgaatcgcctgtcgaatcgcgaaaacgacccatgggtcgtattctcggcgtagccaggaagctgctttttgaatttcttaaagtttctgcgaccgtcatatcttgccgcgttaacaacagacatcattcgagtagcttgcaaaggtggtggtcttcggacagcaatagatccttccttgacttcaatagaaagctgggccaaagattcggtgtctagattcgcctcctcctccttggcgtgttctgatttgatgttctggacagctgatgaaaagtcgacgggtttatgggtgttttgtggagcagcttcggaaataagcgactcttcgtgcagatcgatattatccatgacgatgtctgcatcatcaatcaccaactcctcagctgaatcggctgtctctttcccctccgtttcagcattgttgtcaaccttctgcctcttcaggggttgttggaatagaaggaggttgtctatgggctccacccgagctctctgttttaaaggtcgcctctgcgaagatcctttagaagaaggaggttgactttgcttatcttgcgagctagtaatttctggttgtggaggggaatcagtctcttccttaacaaagaaattcagcagatccatctgttttggaggtgctcgcttgactctgttcacagcagggcgagaggcaggtttggaaggcttcttattctctggttcttctggaggcattagcacagtgtctagtcgttcaacttttggtcttggaatgtttttagacaacgactgagccttgtgccacaggatgctagggttacactctttcacagcaggtagcaagtcagctgcgtcgatcacaatgatgtccttattagccaattctcccatagcatccataataatctgttgatacttcttctcgtgagaacgtaccacaaccttcttgcccgcatgtctctgtaaatcgtccacaatagtcctggtcgtggaggtgtcatcctctaaatacaggcatatagcctttccatcaccttctgtgatgacaggacccagcatttctagctgctgtcggtctgaaaaagcaaatgtcatgccagcccagagctggattcggcttgtgtcgattgccagttcaggttcgggcacgtagtcgctctcatcaggccagatcacagccagtccttcgttcttgcgattgagaagctcattgagaaattgttgtcccaccacatacacccccttgatcatagccaggagcagcttggaggagttcttcttccccttaacataatgagtcgtgtcttctgaaaagtatcgttgcatcctaatatcagaccccttgataatctcatttaatagtgtctcctcctcatcttcatggtacgaaaacgatagcggtcgccatttcaatgtgaaatatgagtcctcctttcgccccacttgaaccctgtaagtcgtgcttctgtgtatcgagaatcgctcctcagatttcagctgcagtccgttgacatacacacctgtgtcgattcgaggcttcttgatgctgacaatttcacatttcgagtcgtccttgtcaatgataagctgaacatgattccggctgatggattttccatccatgttgagaacgtgactcttatcacggcctatgatgaattccgaagggaatagatggtctgatggttagaattgagtgatgggaagctgccagatagacttagccgacacgtagagccttgtgtgacaccctcttctccattaatactcacaagtcgcttcaccatggctccaaacccacattgtggagaaccagtgttttgcagtactgtactcatactatacttgtatacactaggtttcggggtttgtgcatggtggaatctaaaccagtgcagtgagttgactcgtcaacgaagacgcagaaaacatacaactcctcaaaagatatcgccacttctatggatacagaaagctatacatgtcgcaagactccagtgttgctgaactatttaatgacttctatgtcgagctaccccttgacctcggcgtgatctcgcctacaactcgtctccatagacggacagatctaatagaatcggtataaatatagatttacaaacacatgatttttaagggctgccgtttccccgtgtattgccttcaccctatcgtcttcgtccaggactcctgctccgattctcagatccacgaattcgatgttgtgaaatggaggtgtctgcttcatggaaggcgaacgacacctccaggttgtgctccagaaactcaactccgttagtctctgcaatagctgtatcggcatcgtccttggtggcaaactggaggagagcataccctttggcgtaaccagttcttcgatccaggttgacgtgggctacctggacatctccgtatgtgctgtagaagtctgtgagatcctcctcactaatttctggatgtaggttgtcgacaatgatgatccatccctccgtggctgagttagtcaatggtcaatgctgtggctatgatgttgtctcgatctgtgtgtactcacatcgtagaggtgtgggttcgtctgagttagtaatgaatgacgctgttgtgttgaagcgattggtattccgatcaatgtctctgttcgtactcactttctgtaatacccattgtgtcgtgatgccgttgtgttggaaatgatgatttcaagtcgtccagtgtggttgcatgaaactttcaggaagtcactatgaaacgacacacttaaagatcatcaatgaccatatgaggctggtaaataaaaaatggccgttgctggtcgttatatatcatgacataaaaggcttgcacacagtttcaatctcaacgattacccccatcaattatgcttactaagccgattgttttaaaaagttaaactttagaccagcataatcgttggaaaaaaattgaaacttgtaaccagaaaagcagatcttcgattaccaacactgataaaatgtctttcaccgatctaggcttgccagagtggctaaatgagtctctctcaaacatggctatcaccaagccttccgctattcagaaagcctgtatcccccagatcatgaagggaaaggactgcattggaggagctcgaactggtagtggtaagactatcgcatttgctgctcccatgctggctgaatggtccaaggatccctgtggtatttttggtctagttctgacccctactcgagaactagccatccagatagcggagcagtttacagctcttggagccaacatgaacattcgagtcgcgctcatctacggtggagttgatatggtcaagcagagtctggaacttcaaaagatgccccatttcgtcattgccacacctggtcgtctggctgatcatattcgaagcagtggtgaggataccatccgaggattccgacgggttagatatgtagttatggatgaggctgatcgactgctgactcctggcttcgttcctgaccttaaaacttgcatggaccttctccccgatccttcaaagcgtcagactttgttgttcacagccactgttaccgacgctgttagagctctgaaggacagaaccggtgagaagggaccgccattcatccacgagattgcatcagacattgccgtgcctagcactcttacccagtcatatctattcctacctggttacgtacgagaagcctacctgtgggctatcctcactcatccagataacgagaagaagtctgccatcatcttcgtcaaccgaactcagactgcagagaccctgagacgaatgctcatggctctggacgttaagactgcctctcttcattctgagatgcgacagcaggagcgagtcaacgctctaggacgattccgagcccaagcagcccgagttcttgtggccactgatgttgcttctcgaggtcttgatatccctactgtggagatggtcatcaactttgaccttccagcagatgctgacgattacattcatagagtcggtcgaactgcccgtgcaggacgaaagggccagtctgtctctcttgtcactgaacgagatgtaactcgtgtgacgaacatcgaagagagagtgggtaccaagatggagaagtacgatctgatcgaagacgacaaggtcgttgaggagtatctcacccctgcatccactgccaagagacaggccgttctggacatggaggccgagaactttggtgagcgaaagcgaatccagagaaagaaggcaggactggacgttgacatgaagtccaagaacaaaaagcccaagcgtgtagccaagggcaaatctgacaagaaataaaggatccatctaaaaaaaagtgcatttattacaatatattagaatctaatggcgatgcggacatcctcaactacttgtcgttacaaatatgagtagtaggtaggtaataagtagctactgtatgatacggtacatatacttgtacacttacgagtgtgagagaaagcaataaataatcaattttatggagtgccattgggtcggaatgagtttagatatgctgtgtggagtgcactgtatatagaattatgaatacaggtcccctacttcttaccttcatataatccctggtagtaccctgcccaataccaagccatgactagacttcgaacactctcgtccagatgatccaaagaaggtccagtgggtgccgatgccgatccggatcctgggttcgccattgaggtttcgtcgttagaaatgttggatatctcagcagcttctaacaacttgttagctgtgtcggctgtgtcgttcatatccgcatcatcatcctcttctggcatttccttctgctccttgtcggttctcatctcattgatcactgcaccttccgtcgtgctcttcttatggtacttgagatattcctcgtatgccttatcccaggtcgccacgagttggctgtcgtcccattgttggttcatcttgatcgttgtgttgatgagaattcatgcattcgcatattcattttggtcacctaaaaaattaacattcatctaactgcagatgagatgtacaacaacatatctgcatcttcatgaactgcacgacatcgatatttactgatcaacggctggagaaaaagtgtttcatatggtagtttgtggcaacccatgaacggacacggcagtaacttgaaggacctgggtcaggtactattaccaaacaatgaacaattcaagaacgatggtgactctggcgatggggaggagctgcccatgttcccgccatctgaaaatattgggttgacattcaagtcggacgggttgctccctttgcttttctttgtgctgcctccggaaggagatcttcaaaggaaagaattcgcagacctgaaacatatgttagaaaaaggaggagctattttggctcctgagccatcaaacaatacctacaacatctgttacaccgaagaaaccctcataccacagaagtacgaatcatacaaaatttggtatactgctgacttgattcgaaggtgcatggactgtcaatgtttcgatgaggacattgtggaagctgagatgatccttgtccccaacttccgacaccttacaaatgattcagtcaatcatgaagatgagtggtgtctagatcaggcaccctcattgaattggagccctcaagacctgttcttctccactgatcttctcagaccaatcatgaggatctcagggagtgagtacagaaagttgatttctgggtcgcagttgcaagctgacccagcagggtcacaagggacacgaatcggcgtcgatggtgtggacgtggaaatggagggaaacaactcgaaccacgcccctgttgtgaagctggaagatattattgacgaatctactacacctccgctcgctgatgcccttgtgttgaatgctccgaggacggagattttacatcggccaagtcacagagcattgcaagtttacattcagaacaggcaaaaatggcaaaatctaatcgaccgattgcctcatcacgaggttgtgtacctccagcgtgtcactgacttactcagtggcgactttgacgaagtttaccaccaagtatcctaccatggtgatgattacgacgcgataaacagccagcctggaaggtggaactctgttcacgacgtgtatcttactgatgtgactgaatcaaaggagcttgcacaatactctgtggaacaaaagttcaaccgcaagaagtacttggaggagactttgacggtcaacaaggtggcggaatggctagccaactttcaacctacgaaatacggccatcctatccatactattaccagtcaccagacgcttactaactactaatatacaatacaatacagcttgtcagtggtggatccgctgtctataatatcaatacaacaaataataccttttttctataccatgctataactgaaccatctataactagaatcccttcttcttctgcttgtcgatatgagctctcagcaaacgcttcttctcgatgagcgatctcttggccttgccctggacatccttcttgtggatagtcatcatgaagttcttctttcgggccttctctctgttggtggtggagtgaggggcgtctcgctttccctttcgagaaccgaacttttctcgtccttctcgtccttcctgggcctgtgcaattcgctcctctcgcagctgcttgtacttgacaggtccaatcaggccacgagcatcgacctcatcctcgttggtgagcttcttgcccatgagcttgtcgaagcccgcctgggccttgagctcctcgagcttggcaaagtcagcaggagtgagaatcttggtagccataatgttctgggcctcggcagcagcgtcggcagcagcctgggccttagcagctttggcttcgtcgtcgagttcctcctcgtcttcactgtcagaaatgttgtactccttatcgtcctcaatgttgatccatccggactcagagtcgtcagagtcatcatcagagtcagaatcaacctcccaagccttctcatcatcttcctcctggacctggtcagctttccacttggccaacagctcgagaccctcgataccggtctggcccttctcaataccatactggagtcgagaagaggtaccggccttagcgtcagcagacatagccatggatgcctccttacctctatcctttcgtgcaagcatctcgggtgcaacctctcggtagagggaaacaagagatcgagcagccataacaactgctttggccttggagcctttgtaagcagtaagatcctgaagaaggggagcctcaatagcaagaggatttcgtgccagaatctcacggatggtgttgataccagcagagcaaacctcggcagaaacaccatcagagacgaactcgtcagcaatctttcggatcatgggtgtaatggcatcagggggcacgagatcatgggaagcctgcgcggcggcagccatgatctgagtgacgtccttctgcttgggggtgaggtatttcaggaaatgagaatagatgcccagaacggtgagcttatgtgtgccgatcattcgagacacgaggttcatgatctgaattttctgctcaagatcgtatctatacttgcataagtttgtaaagagctggtcggcaaaaccctgggggtctcgcaaaagatgcagggcggaaaagttgaggtaggtggcagacacaccaccgttaccctttcgctttttcagcagtttgttcatggcagactcggcctttcgtcctcgctttcgggagttcttgttgatctgtagtcgatgcttaagagcaccgatctcggcagaggcatcggaatcagagtcctcggcgttagcctcctctcgctccttgtcagcgccaaggaagaatcgcacaccagaaatggcaatcttggcctctccgtgaagagtagcctgagccatgatttccacagttcgggagtcgtcccaaatacctcgtctccacagctctcgggtcagtttagtggcccacagaccagaagactctccagtggacagaacattaaatagaagtgcttggacagacttgttgagcttctgagctttgcttccagtgttggcacccttgacgatggtgacaatgttggagtagatctgagttcgcagctgcttgctgccagtgatgagcagaatggggaagagggtggcgataagcttctcgggggtgatgacacccttgttcttgagaagaaccatagactggatgagcttctctcgcagatcctcgtcgagatgctggtggtgatcgaggatcagcttggacaactcgtcggggaagttggctgtttctttggggtagcacgatgcaacctgtgcgacgaatccaacgagatctccaaactcctcagagttctcagtctgaggcgagttcatgtaaatgtcacgaatggactcatagtgctggtactggagaagaaactcctccttgtaagaaggagggtctcgtcgcaccagattttgcagaagtgcaatgttggtgggcaaaagggctgctctctttcttttagccattgtgtcgtgtgtatgaatagaatgctgcacgatgaattttcttatgcagttcatataatttttttagagttggaactctatacgatgtcgcagttgagatctgttggccaagtaattacttagttactttatttaaatttaatggaaactacagtacttaatgtgtgtatcacctgtgtatattgattcgagttgtggtgggtgcgagtgagtcgcggggtacacgtactgtaggtaagtatgtggcttcgaaacgcattcggttgttgataccaaaagattcctgtccgcatacgggtgtccgtttacgtatcgtacattctctggggtaagtgcatgcggggttgttagcaacagtgacatggaccctggactggaagtggggtggtttttgtcgataaaagcaagccgaaaatgtagctgactcctgcatcactgcttcatcctccaccctgctggactcacatcaaactaaccggatacacgccgtattattgttttggctgttctttgcaccttggtcctacagtaatcatggtgtttacagtgcggagagaactgctgcagttatcgtagctacatcatacatcatcattaacgtctcttcgttccatatgaaccgggacacacttccactggctcattactccaagggtagacagccatgtcatcgcggttttggccattatgcttgtactccgtaatgttggatgtagacggcatcgaggacattgagtacaagtgacttcaataccgtatacactcgtaccaacttccatagagcttcaggatatgaaacaacacggctcgaaagagcaccctggatttgtatggatctgaaactctgtaacgtgtgcaacagctaattactccttgtcaaagtcacggcttctcgctcaataacaaagctgataacgttcacacaaacaatataatataatatgtttgaacggctacaatggtcctgatagtgtgtcctatctgtatgtcagtcggtgatatacgccgcttagaaaggcttatgggataaatatctgcatggtgagtgaacctcatgcatgataagatgtgtctttcaatctctcttctcgagtgaaatcctgtctaaaagaaccacgtgtctataacttcggagtaaccatcatttcgttgcctcggtgtcacattcatagtgcattgttttgacagctgcagacagcgggagccggagatgattgctttgacacaggaatgtgtttcgaaagcagtatattgccatgaccgagtatgtgtcacgtctctattagccaccgacaatgttgagactctacacaatcaatggttgcgtcaattcagcatattgtcaatactacaactgtagttactgcaaagcttccagctgagctagatctcaattttgaataacccaaactgcgagctggttcagtcttggttagcggtcaatctagagttactgtacttgtatcatgaatcaggggacgagggctgttcatcctttgcttggcagcggctaagttcagctaagaaaacggcgctgcgtagatcactttgcacttttcagataagaaagttgggcgactcatttatgagatgctcagcatcttccatttcacacgtggcgacgcttattttaccacagtatgtatattcagtttctacagcaacttcgtttgaagagtaagcccctatacattcgattagtaaaccgcctctacaatgtatcgacaagtataacgacatataaagagtatctctgtgttttgtttgtttatgctacaacaccagcacccctttgaattacgataccggtctcttccagatatggcgtggagttatccctgcaacatggcacaatggatgtctaagtatatgtacactacgtatgtactactacattctgtacctgtgtaccttttcgctaagatgtagagaagactatacttccaggctagggggagtgtatttgccccttgcggggtgttcttttctccgaatgtaacatgaattttggctggaacgtccggatctggtaccgcggaattttcaccccaccctcggtcactcgagaatagacctgggtgcacctgcgtgccgctatgctttgaaaatcagtgctaagacggagtttaacccacttgtcattttattaagcttaatggctttgcaacagatgtgcaacatggctcaagcagacgctgcgattggcgctagacgtgactacaggcccggtctcggttatggacgtcatgatcagagaatttggttgccaattcgccacggaaatctggagttctttgtttgtcgcttaaatgataccagatatgcgtacactcggtgccgttcatagtggtgagcttggcttgcctactgcccgtttatataggatgggaagccatgatgaagagggctaagggaccattgcgcaccaactcacctgactatgaagttctcggctacccttctgttctgcgctagcacccttattgctgctgctaccattgcacctctggctcctcgtggtaaccagacaaagatcatcaatggtttccaggttacagaccttgttaacgatgccggtgacgagctcctgctctttaaggatctaaccaactcctcttggcctggtgatacaagtaccagtaccaatggtgtcactctctattctggagccatcaaggcttggacgtcttcggatgtggcagctgtgtctcagacatcctacaactacctcgagaagcaagcgaagttggcaaacatcgcctactgcggaggctcttcgctgctcactgcgccctttacctgtgcctaccagtgcaaggaatttcccaacatgaagctggtctccacatggggagactcccgaactctttctgccctggttgctggatacctatctatcgaccataccgataaggagattgtggttggtttccgagggtcccatactctcaaggattggatcgttgatctcatggtgctccgaaaggctgttgatgactcctatccaggttgcgacaactgtcgtgtccaccatggtttctatagcgcttacaaagccactctcgcaaggtttgacaatgacctgaagaagcttgttgctgagaaccctggctaccgagtcagcgttgttggtcactctcttggtggagccgttgctcttctggctgccactgatttcaagaaccgaggatacgacacctaccttaccactttcggtcaacccgttgttggaaacactggtttcgccaactacgtagatgatctttggtttggatctgaaacccctaacactctaagtggtgactctagtcgacgatactaccgagttactcataagagcgatgttgtccctcgagtgcccttttggccgggttacacccccaacgccggtgaggtttacattagtgtggctgagatcaacccccctgtctctgctctgagatactgcgacggtgaggtcaacgatcagtgtcttcatggaaacagtctactttccctaatcaacctgaccgcccatcacaactacttcatatacattggtggagactgttaaaccaggctgttttgataccctatttgctggcaaatattgtttgaatatttcatctgttttcaggttttaataaagtaatgaccctctttaatttccatttaatcacctgtgtgatatctccttacagtagtacatacgatagttattgcactttttcccgtgcctgcaatcgtcatcactgcgcgctcataacctgcactacaagcaatgacgtctcagatagccattatctgtggagcttattatcccaaatcacgaggcatgtcgtgccaaagtgatcatctggctaacattgaccctcttaacgaccagcagcctacgaagaggacacgcctttttgccggtatggtattttcttagtccgttctataccctattctctattgcagtaatctctcttttttcgggcatggtatcgcaggaggaagtctctttttttatcgtcaatcagagtgcgtttatctggagcttcccctcaacgacaaataactcaggtaggatctgtctattgattagcccccgtcagctaacagttgtgttcattggcaacctccaatagaaagacaatcagagaggttaaaatctcacctaacgacagtaaatcggacacggagcccagcatggagccacctgagcaaacgcgtcatagtccccggttatttacatctctcgcacgcctggttgagtttaatgaggactggagggacccaaggaagatggaggtctttaaatgccgaccgtgaccgtggaggcaggtagtgacgttatttttgaccagaaaatttgcaaaaataccaaaattcgcatataaatgtcactcggttgatctgctgtagacctcatgaggccctccaccttccattctgtagaatggtctcgtggtatgtgggggataatcttatcccaatagagcattatctctagggttacattcccgtttggggtgtcgcagccactgataacgattttaacctgcattgctggtgctccttctctctcaactaacacaacacaccacaacaacgacaagtgagtatcgagggacatggaatgatggcccgtggcgtccgacggtgacggctactctaacctgtcaattgttgaggccgtctgggcttgcctccgcttgtgcctgatggccagatgaacccatttgccacccaaattcccccacaacgagactacaagtagccagctaacacagtgcgttccaaatttaaggatgaacacccctttgagaaacgacgggctgaggccgagagaatcagaaagaagtacgatgaccgtgtgcctgtcatctgcgagaaggtcgagaagtcggacatccccgtgattgacaagaagaagtaccttgttcctgccgacctcactgtgggccagtttgtgtacgtcatccgaaagcgaatcaagctgagctcagagcgggcgattttcatctttgtcgatgacgtgctccctcccactgctgccctgatgagctccatttacgaggaacacaaggacgaggacgggttcctctacgtgacttactccggagagaacaccttcggcgacctggagcagtacaggttggaataatttagtgtgtctattggctgagcagtgctctcacgctcttatttattccaacatttaaacatcttcgtggcattgactgtggttcgtagtgtgacacacgtacacgtagtttgtgtgtagttgcggtggctgtggctgtggctagcaatgatagtgtacagttgatcagtgcttctatcagatgtggccgactctattatccatatattgttggtgttgtaagtgactcatttacagtagacagatgatcttggagcgttgagtataccctacttcacgtatgtagctactgtatgtccgtaccgtgtcatacagattcataataacgggacagtacatagactacagtaaacagtgtgcttggacatacaagtcgtactgtaggaacgttgaggtcgtttacacatgcttactatttgtagctaggccaagtgggggctttgaatgaacctcatatttgatatataactactgtagctactgtacatgtagcatccgtacaatattttctgtgcagcagattacagtaattgtagctaacagctagtggctaagacagatccaatgagatagctgaaagattaaggtggtacttgtacttgtatgtacttgtacgctgtgctgttgcagccaaacttgtatcttccagcgtacaaatgggtacaagtgcaagtacatactgtagtcgtacgaataccagtccgatacaagtgcgatacggtagctattctagcttcctctgtaagggcgacggtaaaagtacagtacaagtacatactattcaagtacatactgtacgttaggattgcagagcgtggagtgctcaaataaccacctcatccttaacatgcgtaacccacatgtttgtaccaaagacgccacaggaagaagtaccagtaaattgagcgcctgggaggaagcaacacgtatgcccaacacttgtccgcgttggccaactatttccactctcagttgcatcactacaaatactgggagtgcatatataccactcgcctccttttctatggctcccatgatgtttctatccagtggactaagacaatggctgcaatacttgtacgtagtctgatgatgcctgtgtttagcatttctccacgatttcagctcttcccggaaaaacaaggagctcaccagacaatgagcgaaaggaaatttttcagtgctgcagcaaaatcatccgggaacacgttacatgtattcaacgcgctgctcttactggtatagtatttggcacggcacaggatagccgcctgtgtgctgcacaattccggacaaatggaaatgccgccatgaggacttttccgcccacaagcaaattagtgtgaaacacagtttgtagacaaagcaaagatgggaatgataattagaaatatggggcaatttttgaatttgtatacgtacttgtatgtatgtacatactgtacctcgtacctcgtacaaataccggtatttgtatactcgtacatgttcgagataaatatcgtgcgattagctacagtacgagtgaatgaatctaggatacaattcaatggttggtctacagttccaaggatgtccgctcgtagccttaagtcattcactttcgtttcgttcaatagtcatcaatctcttatgtatacattcgtaagtcattatttgcttagagcttgaggccaacgagctcagcgtacttctcggtagagaaggacttgggtcgctcgatgggagcaccgtaagctcggtccatgatgagctggggcaggacaccgatagctcgggaaacaccgaagagaacagtgtagtaagactgctcagtgagaccgtagtactggaggaggacaccggagtgggagtccacattgggccaggggttcttggtcttgccgtgctcggtgagaaccttgggggcaacctcgtagatggtggaaacgaggtggaagaggtcgtagtcgggcatgtgctcgagggcgaactctcgctgggcggtgtatcgaggatcggtctttcggagaacggcgtgtccgtaaccggggacgactcgaccggccttaagggtatcccagaggtacttctcaatgtcctccttggtgacatcagagccaatcttggacttcatctcgagaatccactcaaggacctcctggttagctcggccgtggagaggaccggcaagaccgttgagaccagcggacagagagaggaagggagaggagagagcagaaccaacaagcttggtggtgtgggcagagacgttacctccctcgtggtcagcgtggatggtgaggtagagtcgcagaagctcaatgaactccttgttgtcgccaaagccgagcagagaggcgaagttagcagagtagtcaagagagttgtcaatggagccaacaatctttccgtccttgaaaaggtttcggtagattcgagaagcaatgacggggagcttggcaatgaggttcatggaatcctcgtaggtgtactgccagtactccttcttgttaacacccttctcgtaagccttggtgaactgagactcggactccagagcgttgacggcaataccgagctgagccatggggtggagggtgggggggcatcggtcgatgagctcctcaacatgcttggggatctcggctcgagaggcccagtcagcggacagacccttgacctgagcatcagtggggatctcgccggtgagcaggagccagaaaagaccctcggggagaggctcctttccgccaggggcgtgggggagctgcttctggaggtcggggatagtcagacctcggaatcggataccctcctcggggtcgaggacggatccctcccagacgagacccttaatacctcgcataccaccgtaagcctggtcgaggatgacctcgccgatgacggtgttacccttctcctttcggagcttcttgatcttctcgacgttctcggggatgagctcggcgaatcgctccttaagaccctatttgttagtcgtgtttctttttagtgggttgcagtgtggtttgtattgctcaattgcaattgttatgactgccatctcgtatggttgccgcggggttatgtaatgtcgacttctgcacacaacacattccatattttatgctgctgctgctgcttgaaagcaccacattcgacgtgtcacatgcattcggaaaaacttttgccgaggcaagaacaggtcgaaaatggggcctaaggctgttgcaatcaggctgacgcaacgaaatccgtcgcacagcaaccaattgatgaaagaaaagaaatactcacatcctgggtagagtaggcccggaaggcggtgttggccataggggcaacacgaacggaagatcgaacggcgggacgaatagcagaaatcatgattgatatttcagatttgttcaaatactgacgcaatgaaataatcgtacagaaagagaaaagagaaacgggcgccgagcaagatggtctagtttatatatgaaaagcagcgttgacaggctgattaggcttcttaactttaaggttagactttttgacattcaattgactttctccctactgtcccaacccaaggtacatgaaaaagctccggtttagccgagcgtttacgtggccctataacaacctcatgccaccgcctaaagtggtgctacctggcagccaaacagagggattccctcttgtcactaaatatccatctctcaggggctaatcccgaaactccggcagccattgagcatgtggcacatgtagcacagcggtttacatctcgttacctcccagcttccgttgcttgactccgaactttgttccatgaaattccctcaccattttccaggccaaacgatactatttgatagctcattcggtacgtgctagccacggctatcactccactgcaccgggccaacctccatgtaattgtgtccaagtcaggtggtgttttcagtcgcgtagcccagtgcacgaaaattttcacatctcggtacgtaccccagctttcaatttcacattttctggggaataagcctcggatgtagccggaactcctttgacgtcacccttgccactgcttgtgaatgaaaactcaattcagagtagtatggggtattgccgagcaggtccgaggccaaaaaatgtacctgacattcactagcgtttagatccatccaatgttacgagatgtattccagcagctgcccgctcttcccgggccactgtgttctgctgcattttcctccattccgtagacctactattcatttggcaaaagaagataaaaaaaatgcaattttcgcatgcatgtctctctcagttctcgtcattcggaaggcgtgttcagtgatgctgacggatcaatataggaaaggggctgcacttgtagggccttgtggatctcctggaacaaaaaacacccctcgggttttccgagtcgaacatgcaaacgttcatatgcacaaggtctttctccctctgaagtctggagtcttggtataaccttgtgcgtagtctccatccatccgagagcactgaaaaactcatcatgcatggatcaatagcccgggttagttggttcatgtgagcccacactcatgtgacctcaatcggctcgcaggacgtattttttccgctactctggctgtcaaacactttcacagcaacggtcttgtaacctactgcggacaaatttggaatctgcatggtggaggaaattgatccgatagccgggtaaccccttgtaacgtttcgtggctgttggaaggcgtgcatgttggtgggttagggcttaaatgtcgaggcctccttcgaggggggttaccctacagttgggaggttcgttgatggatttttgaagctcgaaaatatgaagcttagcacacaaacacgaatcgaacacacgctacacacgccttctgtgaggccgaactgtatttttaaaaaatccaaacatcgaagtcagctgtgttcaccagaagcactttcatctagcacctgatcccaaatcaacataatggtacccaacaagaggtccagtgggtcctttggtggatttgcaaacaatgctgctgggtcatcgaccccaggaacaaccccgcccaacaggagccgatcctcgatgggcaaccattcgaccggcaaggttagcaactcgagctttggaaatgcattgagaccctcagccggcctccacaacggacacaatggcctcgcctcttcctctgtccctggacttgggaatggtgtggtcaatcacgttcttggagcagtccccatctcgtcatcatcgtcaagctggctccagaccaagaagcccaaggagttaggtacagtgtctgtcaacgagatgtcggccaagcagcccctcgagcttggctccgagttcgtggaagcctacctcaacagagacgacaagtatcctgagttggatagacttgtgatgcgtgagtatgagaggaggaatctcctgctttggacgacatactaaccacagagggacaattgtccgaatacatttttgctcagtctggtgacttgggagcactgacgccattcacacgaacggaggttatcaatatgcctgacgagctctatgagcaatacaaccacacggagacaagcaccaagatgggcatgttctcagagattgaccgaatctggatgactgtggacaaccgaatctacttctggtcctacatcgatcaagcctaccatgccttcgagggactggagcacacaatcacgtcggtgagtctggtaaaacccaaggccaacaccttcatcgaccttatttcgcatgttttggtcctcaccaccccactagaggtctacctcgttgccgtgggatacaacaagaccacagatgagtttgagcttttcgatacgggcatgcacacctctatcaagggtctggatgtggaccaggttattgcttccaaggacactggaagagttttcttcacaggtcctggcgacggcaccaacgtctacgagcttatctacaataatcaggacagatggttccgagacaagtgttccaaggtctgccgaaccaagaacagcattgtcgcttctttgcaacccattgctatcggtgaggttgctggtgaaggtactggcattctgggtaaactggtgagttccttcctcccatctcatgagcgagaggtgattgttcagatggtcattgacgactccagaaagctgttatacactctgtcatccacctctactatgagagtgtaccacatggccaccgatgatctgaaactcaccttcacttacaccttcccccaagtgctgtctcatctgcagatgatcaccgccagcacccctacctcgcatgcgcccaatcacggcgcccatggtcacgcgcatggccacggtactgcttctcataccggaaccaacagccgtaccaagccggctactcccctcatctccaagcaaaccaagattgtttccatcaagcccgtcatggctactgagtcttctcaaatccatctcgtggctgtgacctcttccggctggagattgtacattcgggctgcgcgatcttacacctttggtgctggaggaacggcaccttctgcatccaacccccccacattcatgcaggtgatccaggttcggttccctccttcctccagccccgaggccgtgcctcccatgcagtccaaggttctgagcggcaccctgggcacctctcgtctctttgagcctggccacttctttgctgtggtccctgccgagactgaggaggagggtgataaggccatgcccacgtcagaccgagtttttgtggctgctcccgacaccggacgaatcctgtaccagcagtcatctctggctgcagctgctaaccctgtttacattgagaacgcctccttccttgaggtggatggtttcgtgcaatctatccagcttcttactcctccattccgagccacaaaccatcccgagggcttcggaaatgagtctgcctgtcaatacgaaaagtctgcccatcagaaggttgccgttctcacccagactggtctccatatttatgaacgaactcttccctatgagaccttccagcgtcttggaggcgatgtcaagactttctttgacctctacggccgaaccgagacttgtgctactgccctgtctctggcttccatgaatatttcgtcccctgaggagcgagagctggcccgaaaggtctacattgaggtcggtggacgagcccacctcgtcgacgatgacactaactatggtattactgctgccagtgtgacccctaccggtaccacctcttctcccccacaggttgtcaagctgtcgggcagatttgaaggcctggccacctacctttctcgagccatccggcccctttggcagcaaaacgtctttgccctggtgccccgagtcgtcaacggcgaggccaaggaacagtttgtgctcaagctatcgcgagaacacattgaggatgcccaagtacgtctcattgagatcagcgagttcctgactaagaacaagaccttcatcgagggtcttgctggagccgaccgagtggttctgggcggaaaccgagccgaagagaccgctcttcttgctgaacataccgctctcaatgctcttgtcaagttggtaaacaacatgaaggaggccacagctcttctgcagctgctccaagacgaaactgcatctgcccccaacggaattgagagtatcatggtgtacctcactcctgctgctcgagagcagatggctaagctcaagttcttcgagctggtcactcgaaaggctggcattgatctggccaaggagcttgtcacctgtcttgtcaacaaggccattgctgatggaggatcggttgagtctgtggctagtatccttgaggatcgatgcaactcgtactgttctgcatcggatgttcttacttacaaggccattgaagctcttaagcgagccaaggacgtaggtgttcgagaccctgagcttcgacaacagctgctggctgagtccgtcagactgtttgagaagactgccggaagcctcagcatcgactctctttccgagtccatcgatctctactgcgaacagggatactacactggggccattcaggttgctctttctgttgctcaggagatggacagagccaatgttgctgcagcatacatccttgatgacatgcctgaaggtgatgttcgtcaagagacttacgagaagcgagttaaggtctactcgatggtttttggagtgcttgagcgagtggttgaggattctcccgtcaactcccctgtccccaacgaggcttatgacattgccctggcttccaccgatgaggtcttccagtactgtttctacgactggttcatcgagactggaaactcggctcgtttgctggacctcgacaccccttacattctgccttaccttgttaacaatgcgaagaagagcgtgaacatggccgacctgctgtggtgttattatcagatgcgaggcagcgtcatttctgctgccgaggttctgttcgacattgccacctcgaccaagtttgtgcttcctctggctcagcgaattgagtgtctgtcccgagcccgaggctacgtcaactgccctgcccccatcacttctcggcagcagcttgctcagctgaccacccgaatccaggagctccttgaggtttcttctatccaggatgacattctcacaaacgtcaaaaaagacccccggttccatgatgctcgacgtcaggagaccatggccaaacttgatggccctatcatgggtgtttctgagctttttaacctgtatgccgaccccctgcaataccttgagtcttgtttggctttattccaggtgtctgactaccgacagaacgatgagattctcaactgctggaacaagctcattgtgcagaccgaccagaagggagaggaggaccacgacggtgaccgcgctcagtcttacgagtacgttgccaacatggtgcagcgtctcggtaagcagttcatggtgtctgagtttgtcttcccttatgaccagcttatccctattctggagctctatagagtccagcaccagccagactctccggttggatgggttgtcgacacattccttggtgcatctcttggctacgagactgtctacacctgtctgtcggacatgattgagcgacgggagtaccccttctccgaggagcatgccatgcgattgctggctctggatgttatttatcttttggaaaagtggttggctgagagccggggcatcgcgcagatccagaatgtagttagtgccgatatgctcgacactctggagcagtacacgagccaaggagacgttgcaggtctgcgaagacgactgcgaatttaatatgtatagataataataaatgtaacataagttgattaacaatatgcatgcgatgaaggtattggaaggtatgaaccggtacttgtacttgtactgtggctgctgtacacataaaatataaaacattcgccacagattgtacttatacaatacttacaggctagatacagaaatactaggtacaggttcgttcacgctgttactattccacccagttaaacaatacgttatgccattagtctatatatattttgattttaaagctgagccttgacccatccctcaaggccgcccttgacgatgatctcctggaggttctgtccgagctctccgaccttctgcttgagaataacgggtccgttcttgccgtcggtgacggtgacagtagcggcaggcacatcccaggtggcgaaccagccggttcgtcgggtcagctcagcgggctgtccctcatatcgctttctcagtttgttgatgagagcaggaatctcaagagtcagcaaggcgttgttgatggagtttcgggagaagatgtttccaaaagagccggcaatgaccaattgcatgtctcgggccagaatacaggtggcggcctgctctcgggaagaaccggtaccaaagttgaaaccagagacaataatgtctccagcgccggtcttagagccaaagtcaggatcgtagttctccatgcacacctcggccatcttctctcggggcacgtcgtcctggtaggtgtactttccggggtagataccgtcggtattgatgttgtcggcgtcacaaaggacgagttctccagtgatctgtgcggggaatccatccaggacccctccactaggagcagggtcagactcggcagcttcggcatcagcctctgcctcaactgcctcagtaactgagatggaggaagacacacccttagctccgggaacgggagagccgtagacttcctcggggaaaccaatcttaccgagaacagcagaagcagcgacaacctcgggagaggccaggtaggccaaggcatccttggagcccattcggcccttgaagtttcggttggtagcagagataccgacctcgccgtcttcgagaagaccagttccgagaccgatgcaggggccacagccggcagggagaggcttggctccggcattgatgagagtctgccaggctccagaggcctcggcgtccttctggacaaaggaagaagcagcggcgacatagaactcgacgccttcagcgaccttgttgttcttgatcacgttggcagcagcctcgatatcggacagtcgagagttggtgcaggacacaaggtaggccttgttgatcttgatgtcctgggcagacagatcagccagggagttgtacaccttgacggagttgggtccagacaggaatggagagagagtagacagatcaatggtcaggttcttggcatacttggcgtcggtatcggcctgaacagcgtccttgagagcagcgacagtgccgtcattcactcgagcatgaggctgaggaagtcgagtcagacggtactcgtaccactgtcggagagtctcatcaacagggaaaagaccagtaagggcaccccactcggtggtcatgttagcaatagtgagtcgctcgtcgacagacaggtgctcaacaccgtctccaacaaactcaatggcgtggttgagaacctcgtcgttgttgaagataccacagagagcgataatcacgtccttaccaaacacgccggcaggaagctggcccttaagctcgacacgagcaacagggggaatctgccaccaagtctgtccagtagcccacacggatgcagcgtcggttcggacaatgggtgtacccaggcaaccgatacctccatacatgttcgagtgtgagtcagaagcgacagtgaggttgtaagggaaagcgtagccctcctcgaccataacctggtggccaatacctcggccggcggggtagaaatcgatgccctgctctccggcaaagttctcgatgttggcatacttctctaggttcttctcagacttgttctggacatcgtgatcaagagtcatgaccacttgccggttgtccttgacagccttggctccaaggcccttgaacttggtggcaacgggccatgagttgtcgtgtgtcatgcagtggctgggtcgaatggaaacataatctccactctggacctgcttgccttcaggaaggccgacggcatatcgctggacgatcttctcggtcaggttctgggggatgcgctttgtggagtatcgtcgcaccaggagtgtttgtgtgactgctcgatttctgaatgcaaacatttttggtgagctgtgtttgtggaactggtctttcacaaattgtcaagagagatcagatcgcccaatggaaaagaacccattgctgactcctaaactctactgtgacataactttactatgactctttcagcacgtgatgcaagataagaagacaaatcttggggtttgctgagacatgaagaaactcattggtattgtttagtgatttcttcggtttcaggagtagttggagttcaatcaccgtacctttcggaacttctcaaaaatctcttagctgaaaagatctgaaatttgacatggatatttttcattaaggtgtgagtttaggtggggagacgaacgccattgtgtgtgggagagactgccagtatggcgcgtaaattaagttgtctcattaacaacagtctgcagatgagccgaaattcgggagaaatgcgggatgggattttacttggtggtgtgggttttataggtggtggttttgtttttatcccgatcatgtccgttctgaatttcacgcttcttgtgcaagtattgtacagttcatgtttgtcagggaacatacaagtgtacttgtacaagctaatttgggatggtatattgaaatgagctaataacagtacaactgcaagtacaagtacatgtactcgcaactctgggatacagaatagtgcagaaaacgatgtggcgtttgtaactgctaaaaccgaacccccaaacatttgtacaagtactcgtagcaaccgctgcccagtgcaacatacactgtacatagttgtacctgtaagtgctctctcctgcaacctctcatccccatatgcattcctctcacatgcagaccataagaaataattgtgctgcacactgaacaccaacaacgtctatgaatcttgctcaatggagcatcatacaaaatggtgcaaaaattgtcgcacacatggggaccggtaacaatgcctacatcatcgcatgttactctaattcacgcccagctgtcatgctgccactcctcattcagatgaatcacaccaacaccaacattgctgttgtggtgcacacagagacagctgcaaagagatattccaaggagattgaagagacgtcaaaagttgcaggcacaccatgttcgtcgcagtgtttcctccggtgggattcactaccaatagattcaaagtgcacctacttcactcccgaatcattcctgaaagcatttggacagcagcaggagattccatacacccacattattgttctagacacacatgaaagattgcaatggggtgaaacggtcctggcggttctcaagaaggtatacaccggacctcttgttctctgctgttctcctcttcctaaggcaatagggtacctccaagatttctacgagggagcttcaatcatagctctacaggacatagaagtcgtagacatgcactatcttgatcacccctcgtgtaatctggtggatactgccgttgacaccgcagtcaacattagcagcatggagggagatggtcatatcataatgtttctatctacacgtgaggaagtactcttggtgatacgagggatcaatgaccgtctccaatctcaacagaaaggaggggatgtcagcgtggtgcccttctacaaggccatgaaaagagaagaactggaggagctatatgatgccctagacaagagaggaggacgaacgatcattgtcgccacagcgatggctcaagattacacgtctctcccgcctgatattaagtacgtcgtcgactctggactgcaaacctcacaagaaggaaagcagatatgggctaccaagctggattgcgagattcgagccaatcgagtatcctctactgggggaaaggtataccgactattcactgaagagatgttcgaggaccttattgacatgtgtcctgccgaggtcatggtcgacaaactggatcaagtagtcctctattggctctcgctcggtgtaaaaaacatccttaccctggagactccttccaagtaccctcagaggcttctttcatcagctttaacgactctgcaccacgctagcttgatatcaaacgatggccagcttacaagagtcgcacaaagtgtgtcatcactctctatctgcctgccttttattcccacacgcttcatagctgctattggacattcactaagcgaatcctgcacgtcacagatcttgagtatcgtcgcaatggagctcgctggaggactgaacgaggcgtactacacccccaaggaggttgtgaagcgagaggaggccaagaacatccatgcattgttccaagtggaggagggaccttatatcaccctgttgaacatatacgaatccgcgtgtacaccaaaactgaaacacacgagatggtttgttgagcattttctcaactaccaaatgatcaggatggctacaaacattcgccacgagctagcttctgttattggtgttggagccgtaaacgccgataaagatgagcagatgaccggttgcttggagatcgtgaagaggtattttgacgagtaacaactataaattttaatgtatttattgacactacatatgtgcttaggactattgtactacaagtatttactctacttgtacagtatcggatatggtcaagatcgcttgttgctgtgagcttacataagcaaataaacagaaaatgcacatgaatacttagagccgatggtattgaaagccaagagaaatggcattcttagtaatagagtccccaaagcattttaaccacctgcttacctcatctatataatataaatagccacctatctcatcgcgtgtttctttagaattcgactgggtgaagtgaacaaggttccgaaatatgtgcaatatgtaagttggtaacaacaccttgattggaaaaaggacgacacgagccaacgatggattcggatactgagtcagtgaaacgaagaaagtcctccgggtccgaaagcgagtcgagcgtgcgagatccgaaacgaaccaagattgaagatgaggatttccaggagaacggcatagacgatgaggatgaggaggaggaagaggaggaagctaaggacgaaggggatgaagacgacgaagaaaaaggagaggacgacgaggaggacgatgaagaaaaagaaggcgaggatggagaaggagaggaagaagacgaagaggaggatgaggagaagaagcgagaggaggaggagaagtacgttaccagcttcaactttgatggtgtggaatacaagtacaaagagcgaccagcagtgattgaggagcgtgaaggaaagattgaatttcgtgttgtcaacaacgataactccaaggaaaacctcatgatcctgacaggtctcaagaacattttccagaaacagctgcccaaaatgcctcgagagtacattgcccgactagtgtacgacagaagtcatgtgtcaatggcagttgttagaaagcctctcacggtggtcggaggaattacatttcggccgttcgatacccggaagtttgctgaaatcgtcttctgtgccatcagtagtacagagcaggtccgaggatacggagcgcacttgatgaaccatttgaaggactacgttaaggctacatcgcctgtgatgtactttctgacatacgccgataactatgccattggatacttcaagaagcagggtttctccaaggagatctccctcgacagatcggtgtggatgggatacatcaaggattacgagggaggtactctcatgcagtgctccatgctgccacgaatcagataccttgacgtcaacaagattcttctgctacagaaggcactgattcacaagaagatccgggccatctccaagagtcatgttgtgcgaaaaggcctcgaccactttcgtgattcgaccacgccagtggaccccatgacgatcccgggcttgaaggaggctggatggacacctgagatggacgagttggctagacgaccaaagcgaggtcctcattttgcagtcatgcagcacgtgctgtcagagttgcagaaccacgcttctgcttggccgtttgcccaggctgttaaccgagacgaggtgcccgactactatgaggtcattaaggagcccatggatctctcaacgatggagcaacgtctcgaagctgactcttacaagaccatggaggagtttgtgtatgacgctcggttggtgttcaataactgtcgtgcttacaacaacgagacgacgacttactataagaatgccaacaagctagagaagttcatggtggccaaaatcaaagagatccctgagtactctcatttggtggagtaatggcgacagggatgcactgaatatttatatgtacaatagtgatattaatgaatgcgatgcaatttatttagatcaatatactaatatcttgacggaagtacacaggttggtcatccatttatactgtaagtacacaattcacgtatatctaaacttcaattgcaatatcgttacacctgctcctcatcgccaacctcggaatcgagcttagcaacaacactgaccatcttatcatcgtcgtaaatcttgaatccctcagacttagtcacgctggaaagctggacgttcttgctatcgagcttctcctccataacctgcttgagaatcttgagaacaaggacctcgccctcctcgagagtcatgtccttgtggtattcgttctgaagctcggcctgagcaccttcgctaccactgccaatagccttggcctcgtatctgtagaaggttcctgatggctcagcatggtagagctgggctccatggtcatcatcatatccagcaatgagaagagcgacaccgaaaggacgagacatgattcgctcctcaccctcagcaccctcaccgaatcgcagagccaaatcacacactgcttgggtcaccgtctcaacgtttatgggctcatcatagtataggtcatgttggacagactccactcgcgcgtggtcaatcatggttcgggcatctgcagtgagaccggacatggcacagccaatgtgtttgtcgatttcaacgatcttctcgatggatgatgcctcaagcagggaagaggtgattcgcttctcgactccgagaacgacaccatccttggtggcgacaccaatggctgtggatccgagctatgttagttggtgttatttgggatggacctatcttgcttgatggcacacgggtgagtgggtgtgattaggtaaaagtggcgacacaacgacgatagatcgccaataccaccagattaatgatacaatcgcacttctgagtcgatagctcatactgatcgttccattaagatggccaaataaccgatgatgcggttgctgcttctggctgagctcaaacacccatgtcctcattatgaacccgtcatcactattgtcgtaattgtgcaacatctgcacattgaatacttactttgatagcctcgagagagtactcgacctggaaaagtcggccttcgggagagaacgtgctcactcctcggtcgtattcacttcttgtaaggaacatgctgtgttgtggtgatgatggtggcaataaactgtgatgcgaagttggggagtatggaagcttacttggatgacccgaaatcgccacaagggaacatgaaccacgataaggagacggtattgtaattaattaaaaaacttcgaagtagtgagagaacaattgattatgatatatatatacatattgaccttactgagatatcatcaacattattagtcagcaaacgacaacgtccatcgaccgattacgtgacttttcatggtaagtgcaccagtaactgaagtaatcgctggtaaacttttttatgatacttgctgaagccatgaaacacatatttataaaagttataattaaatgaatgtatatgcagaaaaaaaaaaaaaaacttgtacgtccacgatgtttttcaatgttccctaaatcttcacatcaccggtacagtatgtacttgtactcgtaccgctccttactacaagctacaagtacactcgtactgtatgtctttgtacagtagctacagtacgtacacccaacctaaaataaacaaacgcgaacgcgacaggacacaattcggctgggtctcaggcttcttttctacaaccgggaaaggtgcttctcgattattctctacgccaatctgattaataacggtcgatttatcaaatggaagtggacgacccaaggcaaggccaaggccatgaccagggccttagtggtatcaagaccaagaagagtaccatcacaacgacaactacaactcaacatatccgctctcactcttctcatccacagcaagaggctcctctgtatgttccaaaggtgtctcttaaccctagcacctctctgccactgttggcgtgcagactcatgcctcaaccaaagtgttcagaggtgacaagaaacacccctcgaccaagaaatattgagacatacgctctggatgttcaggaggttctggtaatggaggatctgcttaatgttcttatgggccacgaaggtgtatacatcaactacagtgactcttacaacccccgacttgagctcgatcgactcaaaggtcctgattacagaactgccagagggttggatccctctttcaaggattttacacgagcgtgcatcaagatcgcgagcacatacgtgtcattgtcggcttttgttgacaaaatgacccgcgacagaagaggattggtcaatggtgccctggcagcctctatccggaagctgctcaaggagtacgtcaagctggcacaaggacttgaatattccctcagatttgaatccggcttgacacttcacaagttccatttaaaattgatgacaatcggaggtatcttacatgagacccatgagctcgccaaggatatcctcagggaggatgaggtgcgtttccataatgccaccttggagccgagcaatgacctggatgcacttcttgccaagttccgtgagaacagcgtggaaatcgacactcgaggttacggaatctctcttaatggttcgagtatgtgtcgaggaggaatcacattgaaggtgattgcagagagactaaatgcacattctggcgacccaacagcgaaccaacttctcaccagactactcaacgatgcatccaagccataccttcaaatgttatcgcggtggatttaccagggtgtaattctggatccttacggagagttctgcatccaagagaacggagaccttgctactggaaacgagggtgcatacgatgagtactgggaacaacggtactctgtgcgcaaggacgagttacccctactcttgtcccaatcgaatctcctcgagaaggtccttttggctggcaagtatctcaacattgtgcgtgagtgtggaggaggagacacctcgaaggacgcagctgttaactgggagtccatccaagacccggcgttagtgcccagcattgcatctgccagtgatgagtccaacagagccctattatcccttctgctctcatctcataacctgttcgaccgtcttgcatctttgaagcattatttctttctggaccgtgctgattactacatcaacttccaggacattgcctggactgagcttgctcgcccggctagccagtcctctgtgacaaagttgcagtaccttctggatctatgtctacggcagcctggttcaatcactagcactgaccaatacaaggacgacgtggttgcttccctggcaccaacaacagtctgggactatcttttgcagattgtgtgtgccactgatcccaacgaatctggctgggaaagcgactctagaaagatgtccatggatgacatgcctgtttcgtgtgcttttcagctagacttcaaggtccccttccctctctctctcgtcatctccagacgtgctctgattcgatatcagatactctttcgtcatcttgccgagctgaagaaccttgagcgactcctcagtatcgtgtggcttgaaatggccaaatctcgacactggcgctaccctacgagcgacgagagactccacaagtggaaggctttttcaaacattcttcgaatcaagatggtggagtttgtgaaacaacttctctaccattgcactgctgaggtcatcgagcccaactggaagcgactacaggagaagttcaagtctgcttcaaatgtggatgaactcattgctgaccacatcaccttcttggacacttgcctgaaggagtgcatgcttactaacgaaaagctcatccgggtgcagcagaagatcttcgggtacatccggttcttcgtgaacaccattcaggctcgaagtcacttccttgagatcgtagacccgtctcatttgtccgatttcgaacgaagccgactgcaacctgtgtatgatagaaacggagccactatccccaacgacacgctggtagagcggatgaatagacttgtcaaaaccacagacaccaacttcagccatagctgcaaggtgttcaaagatgccttggagttcttcgcagcaactgaaagcacatctctgttggccctcagtgctcgtctgagttgattttatgcaacgatgtatataaccgaggttttcaataatatatttatttattttctagattttttcactggctgtatttctcacaacttgggagtgttttgctccccatcagcaggtacttaatatacttgtaagtatgggttccctcttttaagttgatgcacccgcccagctctggagaatgcacatccacggacgccggatgacattaactgccgacactacagcaccaactacagcaccttctgcacgtctatccacgggtcgccaatcttcaaacgaagctgtgtcctcaaccatgacctatgacatccttcttcaactaccatgaatacattagctccaacgatcgggcccaaacccaccatccgaacatttacgtggagtatggacaatcagacaccaagctgaggagatgtgtgagggtcccaagagactactcagtggtgggcgatgagtacccttacttctcgacgcattttgttggcgaggaaccaggcgcttaccctagcgaagagggtccaacctacgactcccgcagcccactgaaggatataatatcctatcaggagtacaatgatatcgtgggcaccatcaacggctacatgaagcgtgcattttcgccctggcagaaatgccagtttatcgagacagtgctttcattcctgaccctatggatattcgaacgactatttgcttcaaacaacgaaagggtcttggctcaactggatgagtacatcgatcagttgaacagtaagaacgcagaccgtttcattttgatcaacccacgcaaaaatggatttctctccttggactttttggtgatggtaggagagcccaacatatagatcaccattccaccagactcatcttaatatatatgaatgtattattatctacacttgtacatttgcacatactgtacatacagtactgtaataaattaacagaggatgggattgccaaaaaaataccagtgcttgtattaggcaggtgtctttagaacagtggtggccactgtattgttcatttcgtcgtagacatacagcaccttgcctacacacttgagaacccagaagcctggattcatggggtctccaaagaagtactgatgatagagctcccgcgtaaggtcatttcgtctgtcatcgtcaccgtgcaagagcagcggcatactgagattagcgtaaggtgtgggtggcaagccccattccacgacatagcttccaataccgacatcaaacgtgtgattgtgtttctgaacaacataatccacagcgtaatcccagagttgctcttttcgggattccgttatcttgcactgccacagagcatttctggcaggaatgagcaccagctcttcaacaacctgtgtagtctgacgctctgattgagtggatgtatggtatcgtgagtaacgcataccctggtaatcctgcagaaagatgcgcttctccttgcaatgctcaaacagtgcttttcgaggagagttaggaatgttcttatgatagggagcggcaggagaggagtcaggtccatgatattggatacagccgaccaacggctcggacttataatggcgagggaacaatcgtctgggagtctcatcgagccatttaatcatctctctattcaaggatgccagagacttggcagtgacagtaaagaaagccagggagctataatcgaagacaaccataagccattggcatcccgtcagagtcatgggataagggccacttatatcaatcaatactgtatcaagaggcataggggagcggaaagaagtgggggtgtaaaaagcagagaacggggtggtaaagggcgtcttatggtgagccttcggtatgtttcgagattcacgattcatggtagagaagcggacaccgttaccattcagaaaatcacagttattgatgtttttggtcagcgagagagtgtcttccttcaggggcatctgcacaaagatagcatcctcttggccacagtccttcaacacagatacaactcttgaaaagttacccttcttgacgaacagggtaccaggatcatcaaaggggcgagagatgatttcgtaagtggagcttagaacgttgcgatcgcgccgtgcgcggtcatcataaacagcttcaagatatcctccttcagcgagacaaacctttcctcgtagcaattctggattcttcggatcaacataaacatcagtaagcatatcagctgagcacacaatgttattttcattcttgcccagggcagcaatctcccactgagacatccgttccatagtatcgtctgcatatgatcgataccgggtgaagaaacggctttcgtagttcttggcacatgctttcacttcacgcttgggggcatcgtcaatcttgcgtctcatttgagagctcaaacctcgacagttgggcacccaactagcaaaagtttgaataatgaagtcactgatctccttggggtctttgaaatgccgactgagagcgagtttcccacagatactcttacgctcagctgcacctttatctaccgcaggacggttgtagagacgcagagtatcctgaattctgatcacttgctgatatttgtcaagaagtctgttcaagggagaagatacaccatctgagaacacaacgtgcttgatagcttccaacatgatatagaactcgtgattttgaacccatggcactcctagtcgtgtagaactgtaggaaaacttttgcataacgctgtggcaagcaatatcaaggaacttgtcacggaggggcgcaaagttgaacacagcctgcttcgccttgtactgaggagccttcttgaggatctccacctccttatctctagcctctgcacgatacagctccatactggtaacccagagaagaatctgatcacttcgcatgaatctgacacatcgagtttgcatacacacacgcaaatagaggtcagatagacctcgcggatctcctccagacatgctcagaacaataagatccttgtttctcgtgtaaatatctttgagcttcttttccacagcaggagacagctccttcgtcttgggagaggcgattgcatctcttatctgtgcgtgttcctgaaatgtcagagtagggcactcctctgcaggaaaatcagaatcgtcgatctcggggaatgagagaatgtattcccggtcggccttgggcttgaatgtaccttcagccttggcgtcggacacaaattcggcgtcgtagtccaacagcagaccctcttttctgtggtagagctgttcaggcttgatcagggcttccttcagagtcgttggaaactgcagtgagctatcagaaaaaagcgaggtgttggtattgtctgccggagaagcaatgtcgccagacgatcctccgttttggaccgaagcgcccttggtgccgggccttttgttattcttcttcaccatgataccggtgctgggttcgtgaagctgacggaattgatggtgaggttttcgtgcatatgcacaacttaatcaatgtatgaaaaggtcattccatgggtttacaactaaactgtgacacggactacaagagggcgattcaaaactcgtctgccattgtttataacgaccgttaatcactcgacaaagtcttacgttgccacctgagagcttcacgtcacggccacaaaccgcctaccatgcctccagccaactggcccagcaacatcgtcttcatcaaggagaacatttactcgaaccaacttacctccgaagagctagcaaacataggtctgacacccgccaaggcaaaaactcgcccaacgccaaatggatctccaaccaacaagctgattaagatcaaaaagatctccgatcccaagcaccctgctaatgggcagttcggtctgtttgcaaaccagaagttgcctgcaaagtcgcatgtaatcgactacgttggctatgtacatccagacagagaaagtgatccctcatcggactacgacatcagtcttgactctgcccttggcatcggcattgacgcccagagatgggggtgtgaagctcgtatgatcaacgactacagagggatcaatgctaccaataacgtcatatttgacaatcgcatggtaggaaaagagctgcgaattgctgtgtttgtgggcccaaaggatgtcaacaagggagaggagctatgcatcaactacggaaaggggttctggaagggacgagcaggatgacagaatatatttatatcggcgcatatctacagtgcagtacttgtggtatcattgggtagctacacacaaatacaaaggcattgtatagctacataggtcaactactgtacgttacaagcaatacatggtattcgcaaggctgatatgtagtgaacacagttcgattgtagtatatgcctctcagagtagggactccagtagacttcaccttgacgaaggactccattcattcgcagcataggtcatactatcgaacacgtccagagagaccactaccttcatacccttattccttaagatactgtacatacagtatagctcagattagagcagtccccagtaactacgatcgcaaaatgcttttcaaatggatattcttaaataaccagccatgcccgactgggccctcagggtctcgcccgttcttgggtcaccctgtgtccctagctcttcttgagcgttaattatccttctcagtaataccagttttaccatccttccatccctcatccatcgtagtacatcctcgtcgacaatcttgtactgcaagaaacccttccatctctctacttgggtgggttcatgccctgcatcattttaaacatgtcaggcatgccctcgccaccaggcatgggcatctgacctccaccaggcataccaggcatacccatcatagacatgcccatcatggccatcatattctgggggttgtattcgcctcggatctggttctgtttgtcacagtaggccatccaggtgaactcatcgaagccgtagttgaagtaatcagtgatatcggcaccaggcatccgccatggcttgtcctcgaagtcctctaggttgtgctcagtgataggctttccatccagcataccgaccttttcgatgtcgattccaggcatcttggccgcaggttggggccgctcttcggacgcgctctcttctttgggggtatcagaagcctcaggtgccgcagaagaagctgccggggcctccttcttagcagcagcggatgccgtagaagcgagcttgctgggcgcgccggtgtcgatgacaatatcaatgtcagagtcgtcggattcgtattcagaatcggaatcatcttccggttcttgttgcttcgtggtctgcgagtgtggttcctcatcatcctcagctccctcgggctcaactcgggcccgctttaccgcaggctcctcggtgccgtagagaaagtcgtcgtcgtcatccatctttgatgtcagatggggggatggtgatgttgccgtggtgggtgtcgtttggcgtagtgctttgcagaaacctttctttaggtttgatggtggcccaatacgaggagagaatgtggcgaaatggggagttttgagggtatatgtatgagaaatttgagatttctgaaccaaataaatttacagtcatattatctctttaaaaaagcatctctagactgctaaagacgtattagcgtccctcaaacatggctgactaacacaactctatttggccacaccaaacactgctgatgtatggcggcggtggtgatatgactgcttcattgctgctggttaaacaacatacaagtatgtactcgtacttacaaataacgtgaagaagtcacctgtgctagcccatcaaaacagaaatgttttacaatagtttggagaatatcggtacaagtatttcgaacagacgctttagtaagacattggatactcctataaggaactcatgtcgtttctcgttctacttcggtgcgaaaactttcagaaggacactgcagaggaagacattcatacctgtaccttcatgaaatcatcccccctacagtacaaagaatcgagcccctttctactgtagttcagaagcaatagggttatgaaggaccttaacgaagagctaaataccaccacaataccacactccattcaccacaaccacctgcatcaggacggcattaggttcagccatctcaaatttcacaccccaccaccatcatcatgtctggaatcgtccccgaaattccaggcgaacaagcgcccccagatgctgctcaccagctcaaggtggatgttgcgcgcctcttgcaaaaacccaagctcaactttcctggtgctcagcccgtctcattcgccagaaaacacattgaagaggagctcttcaagcgagattattatgtgtgcgagaagagtgacggtcttcgatgtctcatgtacgtgacatgggaaaataaccccgacactggcccccagcaggtcacgtatctgatcacacgaaacaacgagttcttcttcattcccatggtccacttcccttcgaatgatggtaagccattgcaagacacaattgtcgacggagagctcgtgctcacaaaggccgaaccccgatccctgcatttcctcatgtttgactgtcttgcctgcaacaagattctgcttacaggccgacctttggacaagagattggggtacctcaatgctgccatctcgcatcctctgaaagagtacctgcacaagaaccccgaagttgcccgcgactttcccttcagtgtgcgcgtcaaggatatgcagtttgcttacaatgtgatgaacgtctttgccagcttcccgcaccttccgcacatcacagatggtctcatcttcacctgtagggaccacccttacgtctctggaacagacgagcgaattctcaagtggaaaaaacaagacgaaaactcggtagactttctgatgaccatgaagtttcctattttcgaggacacaaatggtgagagttggacagactacgacgcaaaacccgaaatcacactcctggtgtggacaggacgggacggaagccgaccttacggcgagctgtatctcactgacgaggaatgggataacttgaaggcgctggaggagcctctggaagagcgggtcgtggaatgtattaaggatgataagaagcgatggagatatcttagattccgggatgacaagacgaatgccaactacatcacaactgtcgagaaggtcattgactctattgatgatcccgtctcagagaagaatctgttagatgccgctcccaaaattaaggagctgtggaaggaacgaaatcgacgcccacgcgacgaagatagaaagcgagtaggaggggacgaccatgatcacggtgccaaaagagctcgacagtaaagcctcaacccagatcaagtaaattatatattgtaatattagcacacatacttcaaaaccatatgggaaaggaccacaagtagacactacagtatgtacatacatacagtacacgacaaaaagttatggagagtgatgggaataaataaaaaagcaagcaaaaaaggtttctccgatacggggaatcgaaccccggtctccacggttctcaagatgagagcgtgatgtgatagcccctacactatatcggaagttgaaaatcagcccgacgtggggcttgaacccacagccttgagatcacttttaagtaagagtctcacgctctaccgattgagctagccaggctggacgatattctgagctaaagttagagctctcaatacaaaaatctggaaagtcacgtgaccgaaattttgaagttgataataaaacgccttacagctcatggatttcataaacacaaagggatatgatgtaggtggaattattaacattgtgagctttcgtctttaacttattaccctgatatacaacaaataaccaccttgtgattctgttcctctggccgctcgtgacactttatgggttagggttcataacagatgtcgaggatgacgatgcacctccacatcaccactaattagcatgttcgcgtttgcccaaaagctcgtgtcgcaggctgataagtatatcaacgaggcccgtgatgaggttgacgatcagccatgctctcacgggttcagaatactacacgtcgagcccaattcaattgcacagaaggctggccttgaagctctctacgatttcatcatcgctgttgatggagagaccgtggaccatgagacacaggaacacaacccttacgccagacaatcacttgaccaacccgttcaggcacccgtcgatcgacttacccaacgacttactggtgacaatgtgaccctgactgtgttctcttccaagggacacactgtccgaaacgtccaggttgatgccagcaccgccaagcctgagtttaccgaacccgatgccattcagctggactctgtgcatggaggagatttcgttcgtggcaacgagtacgacaaggaggccctcaaggaggccagcacaccaccaggactgggtgtcagtcttcagtacactcctctcgatgtcggtgactacgtgtggcacgttcttgacgtggcccctaactctcctgccgagcgagctggtctcattgcccactctgactacattgttggtggctctggcgggttgttggcctctggaggagaggatctgctttcgcgagtcgtggctgtgcactactctcgacaagaagactgccccattcagctctttgtttacaactccgactacaacatcactcggcctgttcttattatgcccatgagaggttggggaggcgcgggtcttcttggctgtggtgtcgggtatggccttcttcaccgactgcctgagttcctgggagttaacagacccggcgacactgtcttcaacgccgacgaacgagcatcagcatcacctgccccccctcagtcttaccaggctcctccccaaggcggtattcctgctgttgcttaccaaccaccttccgcatacgctcctcctccccccaccggtggtcctcggcgggccaagaagcctgctactgccataaacgacttcagcgattactttgctgagcaagagaagtcttctcgagaggctgaccgaatttctcttgctgcccagcctgtcaaggacatcccccctcctcccaagaaggcgtaatcttcttgtttcaaagactggagttgccgaaagactttaacaagttgacgagtcagccgatcaaacgctgtacagaactccctcccaggcctttatgtataaaacgaaaaatgatttaacaactgatatttgtaccactttaatgtagaagtaatgagatgacagcctttccggagacgagcaccaaagttagatgaaagggagccataatgtaggtttcatacaagcactcggacacttgtccctacagtaattcccatttgagacacctgaacaagtacgggcacagtaattgtactacttgtagtacaagtagactgcaagtacatacataatgtacgatattacagcatgcacaagaacatacacaagttagcttcaagatattgctctgtgtttgcgtattaaatactttctccggtccacatataactttgcaaacaatatattacagtacacttaaagctcatcatcaatcttgcctcccttcttggccttggtatccttggcaggggcctcctcctcatcggcatgggcgagaccgtcaaccttgtgggtaccgtgctccttgatgaattggttaagaccctcaagggttcgagcaccggggtaggtgataggggcgttcttcttaccggcggggtacagcttgatagtggggaaacccttgacatcctcatcagggaactcgttagtggtggcgtcgatcttggcgacagtaaccttcttggagatctcggggtggtcgaagaagaggtctccaagctcgtcgtagatgggagcaagaatcttgcagtgtccgcaccagggagcgtagaactcgatcagaacatccttgtcatcatcgagaacaatatccttgtagttcttgccgacaacaatgtggacgggaccatcctggtactcggggacggggtcagacttgaggataggctcgagagttccctcaatgtactccttgaagaacttgtcgacggaggccttggtgatcttggcatcctgagcatgggcccacttcttcttgttgtcgaagttctcgatagcgatggcagggaacttctcctggatgttgacgttctgggcgtgagatccgtagaggtcagcgtcaatgacaccgacataagcctcacccttcagcttctcagcccaaggcttgacccactcggagatctgcttggtgtccttctccagagcagagaagatgtagaccagagggaggccagatgtggcgtagtcctggaaagaagcgggaccaatctcaccaatgacggggacagcctcggtcttgatgaacttggtaagaggctcgggcttaaacttgaacaccttcttgccagcagagatgtcgtaaacggcgggcttctcatcgaagtttcggtagacaacgagagcggggaacttctcgacaccgtacttcttggcaagggccttgtcagcggagtggccgaaagtgaatcgctctcggagcttctgtgcgactcgctggaaggtggactgagacttctcgtcatcctcatcgtggaaggcaacaatggtgacgtcgttgtccttggtgaaggcattgagctctttctcgttggcgaattcggaaacgagaggaagggcctgcttcagcaagtactggacaattgcctcggaggttcgggcagactggtagagagagctgtcctcctcagatccacggaagatcttgagggtggggtagccctggatctcaaacttggagcagagctcctcgttctcggtacagtcgacctttccaatggggatgcccttctccttaaggatggtggctgcagactcgtactcgggggcgagttgcttgcagtgtccgcaccagggagcaaagaactcagcgaggacgagcttgttgtcagtgacaaagtcggcaaagttgtcggaatcgagcttgacgacgtcggaggccgcagccagagcgcccatgagcgcaattgtgagggcagtgaacttcattttggggttgttgaggagaaagagaggttcaggatgaggatgctattatgtagtcctgagttagtttgtgccacgtaacgtaacgtttaagttcggcagaggcaggtgtgggttggatgactggcaacaataacgtgttctgtgatgtatgccgggccgttaagctacatttcaactgaatttgggaccacgtgcagcaatactctcacgagtcaagatggacccctgggcacgtaccatagatcctcttgtacttctgagcaactactctcagttgaactgagcttccttttaggtgtcctttttggctcgagaggcgctcgagttatacgcttttgagttggatcaccctgcatggtgaaattttggacgtgttttggagagtgacggaaggagtgacttgttgataatatcataaagtccaagcaatgacgaatacaataatacaattataaacggcactgatatttattgaatcatcatccaacagaccaggccattcaactcaatcactttcaatacgcgctgtcactaatcaccgtcatgtgagttcagagttgcacgcatgaaccccaagatctggagtcctctgctcgcgccaaccgctcaccatacatgattcgcgtgccttgatcttaattacatcaaccgagcagtttgtacgtgttgccccatacaagctccgaagggcgttataaggactcggcaaaggtgctattcagcccccatctggttctggaagttcgctactaactgggtgtgaggtgtgaaactgcacacatacgtcagtcattctctctcttccgggggggattgttgcgcttcactcaaaccttcaggtggccgtgcttctacggttcagatcattattaagacctgacagatggtgacgttaggtggcgtatctcaagagtctctcatcttcactgcctccataccattagtcatgcgttgtagtcttacgccacatgcttgacttgagttgttaaacaaggagaaggcaccagagtcttcattcccccaacttacgcgtccatacaatcacccggtcacccagcgcaaacaacagctacctgtagcaccagtctcttaagtaatcaccgactgtaaacgccttcacaagtacctacacagtccatccgtattcggacaaattacaaactgagtttgatataagctccaagcgagatgagttggggctttttgctgacgtgttagcgtcaagggtgagggcagccaaaagacagccatcgaacaattttgtcgtttctggcaagtggcgaaaatcggtaaagatggggatgtgagtgtgacatactgaggcgttttgagactctggtagttgccacgacataaacatgtatcaatgcgtgtacttgtactcattcattcacagatgtccacgtgtttgatcattgtgattaatgaaacagccgtgcacaccagcatggaaaaatcagctgtagagtgtaagcgagtacgacagctacaagttctcggaatgagttccaagaggaacaagatacactgcaagtataaacatagattatacctcagttggtacttgtaccgtgtgttttttggtctgtaataagtggtaagacgactctgtatctgtgaaaaatcgagtttctttacactggatttttttgaacaatgtgatctacaattagggcaagaatgacaagcgacaccctgttgcattgaacttgttggcgtacatatgacaatcctgggcatattagaccatcccatgaccctgtggggtatccgaccctgtgtacagcaccgtggcactgtataatacatctgacgttctgtactcgctcagtaaattatcgacagctacaagtagtacatacagaaacactgtcgttgaagacaacagtatgacaagctgcagcatccagcagccacatccggatctataaaaatccgactgatgcgctgtgacacaagaattttggcactaagaacgctgtagagacactcttgtccatctcggacactaaacgtggactaacaccgatctcctgagccagaatccgcccgatgagatatggtgggaaatggacattaagccagcagtagggcaacggagaatcctttgatgtatggctatcctggtctgttggggtggaacaacatgtaaacccaaacaagccagatgccaacaaaattacttaggaagcaagcaaacaaacaaaacaaacccacttctgatggtcaggatttagtcttagccaccagagacaccctcccgacgattgtcagaccatctgaccccctttacactcatgggtagagaatctatgagcaaccgcttcctccagactgcatgctgaaatgcgagggcgtgggtatttcgaaactcaggtttgggtggtgggatgctccttgccggagaccatgcaagtcgttccgagccccaataaactgaacgagcgatagaagcggagatagagggttacacattatgactactcttgtacaggcttgggtgtgcctcagtacaacgagtcaattaagtaatcgactacatagtcagacactgtgtactgactgaatactattactcccggctcacgtgacacggtacaaagttgagacagacgattcggatctcaacctgcaaactgtacgccaacagccgtagctccactgccaattaggtgcctgctaaaaagaaacaccaggggtacaagtacttgtctcgtaagagtagttgtactctacgtccagggatcttcggaaaggtccggattgtagcaacatcaaaaaaggccgtcatcagtatatcaatgtcatatatggtgacgtcatcacgacaaggcctgctgtaaaaaagtgtcagggttcaatatttcgtccaatggaatatatatgtttacaaagtggtcaaaggtgtgtccttgtgtgcacctacaactgacggtgctcggccggtacctacattctagcgtggagttacggtgttattgatgcagaagcgcagccgttctgctccagggtaacacacgtgcgatctgtggatttcacattattttagggtattacatcatcgtgctgcaacggcaaggatggggtacgagtcttagggtaatgctggagttatgatctctacggtgtaaatgttgattaaatgtttctgtctcactctcaacttcgccgcaagtccgatccggctttccccacagattgcatcatgggagacgatatctttttaggttgttcacacgaaggtcatccaaacatgctgagactttcacactcggtagcttcctttccccaccccacctttgaaaattaaagttgcaaaataacctcggcacttggggccgttgtggagtagactaagtagtgtgagatacttggatcggtacaatgtttggagtgggacacacacatgtgctccgagaagaacgcccaaaaagggcccacgcgtggctacagcctcagattatgatgaaccaagagggccccacacacgcgcagcgatgtggggaatccgtctttgtaactgaccgataaatctccgtgtggggaagtacaaaactgtggcagaagccgaacccttaatgttcatgcaaacaaaccacatccgagagagccggtaaagccgtaacggccgacgcaaacagacccgaatctgaaccgattgctgtcgataagtcgggtacccagatcatatccatctggatagggacatggtccgctatttttattatttcccgtttgaaccgatctcacagggacttgccgagacaccccgcaatcacgctagagtagtttcggcatgacaattgtagcgctatcgctaaattactcatatgccctggggccttaatgggttacaggtccaagtgtggaagggaataaagatacgggtggtggggaccggtgggatcaagctcagaagaaagcacttatatataccgtggggtctctggtttgcccagcattcctccaattttatcctacacacgaaaacaaacatatctcacccaccctttacgttcctgccaatcccggtttcaacagttacagtttctatcaactgcatagcgtgcatcagccgaaaagcacaagaaggcccatcacaactcaacgctaactatccttatcaactcacccatctcactcacgtcatggcagctatttccaaagactatgttctgtcgccctggggcaaagccgtggctggtgccgctggagccgtgctcgcaaacacactggtctaccccctagacattgtgaaaacgcggcttcaggtgcaggtcaagcgcaaggagggcggaccccttcctgccttcgaggagggccatttcgagcactacgagggcactgtcgacgctctgaaaaagatctatgccgccaacggcctggccggcctgtaccagggtcttccctcttgtcttctaggtgtggcctctaccaactttgcctacttctactggtatggcttcatccgagactcttacattaagcgaaaccccggtaaagctctctcgactcccatcgagctgctcctcggagctgtggcaggagccctggcacaggttttcaccatccccgtggccgtgatcaccacacgacagcagacttcagacgccaagtcgcggcagggattcctggctactgccaagagcgtggtggatgacgacggaatcagtggtctctggcgaggtctcaaggcctctctggtgctggtgatcaacccctccatcacttacggctcgtttgagcgtctcagaaccatcctgttcaagggtaagctgcacctgtctcccggagagaacttcctgctgggagccttgtccaaggctatggccaccattgccactcagcccatgattgtggccaaggtcatgcagcagtccaagaccaagggtggcaagcagttcaacagctttgtgcaggcattggtgttcctgttcaaggaggagggtattttgggaatgtggaagggagttggcccccagatctccaagggcatcattgtgcaggggctcctcttcatgattaaggaccaagtcgagctcttcatcgtgctactttttagactcatgaaggcccccaccttgatcaagggataagaatagacaagacattgtagagcttagacgatgttaatagatatggatcgtgattttgacatgtcacaactgtaatctggactaactgtgggtggactcaattcagttgacagttacagtatgtacttctcagaacaatcacctacaaggtgatgacaggaaatatatatgaccctaacatgatatatatgatccaagtatatcggtttcgatgccgacgttcgatgatctacgccacatttcgcttccaaaacaaatcatacacaatgccttctattaggtatctgttaaattctactttgaattacaagccttatatatttaaacacagccgtaccccgcgtatcttgattccaccgataacttgtgtcattcacttctgtctgacgcctccgcttctttcatgcgatcaaaggcatctccatcagaaacactgctggttacactgaaccggcctcccgatccaaaattggcacgggcacgagcactaagaccagcatagggcatccaagcatccgattgagacattcgtcgagggtcagggtttagactgacggctgattttggagatttcataggtacatagactggactcgattgcgatggcgacggcggacctgttgcagcagagccggtgctcagaacgctgaggtttgtgtgggaagggttgtttgaggacgagggcatgttgtggccagaggaaccagctcgctcaaaggctcgagacattcgagacgaaatgttagatgtagaggaagccaattggggactgctgatgtttcgagaaccagcaaagcccgttacaacctgaggaacagtgtcattttcctggtgaatgggtgtcagggatgaaagataaggatggttgggggtgtggtaacccgacccaggaatagatcctgccatggatcccgaaacagaacccgcatgcgagctaggaatggatccaggcggcacatagctgccaggaataaagcttcctgagacagatgactggccactatggaagccctgaaagacaggggcaggcggtccggcataagagtgtcgaagattgcctgtgctttgggagtgataaccgtggtagctagcgctcatctgcaggttcgacatggatccgaatcgcttgcgtatggaaccggcggcaggcttatgtaccaatgcttctcgtttgttggccaattcgaccatcatgagctcgaacagtcgtcttatggtgtcgtcggttgggtcaaagtcttcgcagaacatttcaaacgtatagctgacctttttcgattcctctttttcacttttcagatcttcgggggactcggtggccaatccggaaatcggaggcacccggccactttgtgtcgttccacttagctcggggttgatgtaagcgaacccggacccctcgtcatcgtcctcctcttgtattgcgtttgcggccgaagccgaggaagatggggtagtcgaagatcgagatcgagacggagaagaggtgtcgatgacatagtatcccggggggatattggatgttaaatgcttcaacgatgccagtttttgggcaagtgccgatgcggggtccatggtgtgatacttagttgtagtggtgttcgagtgagtcagtcatgcaagtttagcgtggggatttgttgtctggggactgtgtgaggtttgtgaagataagagaagggtaaggggaaaactcttcggcagtacggaagctaggaatatttttgaatgagattaacgacatatgaagaggccatggatgccaaaactcggttattgccacttttttgggatatcacattttgatgaatagtaattggctgggtgggtttcccgtcacgtgagacgcctgaggagctgtctgtctatcggtgggacaataaaatggtattttaattttttgtcagaatttggtccacggccataatggagacgagccccaacacactcccacacactaaatacgaggccggatattaaagtctggcggacaatatctgatcggctgcctgttccccgcctccgcacctcgctcagttttctttacgcccacaagtaagggtccagtctatcgcatgtgcggtgcgatgcctcactgtaagtttttttgctacttgtaggtatcgaaattgccttttaggcgagtaaacgatggcacggcctaactggcacgtctctaattggagaaggtgaagcagggaggcggggcggacctataggacagactagagaatcgtagagggtagtagttcctgttccgagccttgtgaagtattttaatccacatttccttctacagactgcaccacaatatgcgcactggcagatacagggcaccattgctgcactcgtaatagtgcacatctccgataccgttacaagtacgcaatatatatgaaacgctattttgtctggtcacatttgctggggatattagcggtatatgacggaataataaggattataggtggtattggtaggatgagatgagggagaaatgggaagggcaaggtagagacagcttaacaaaagagcagtagcttccacagcgtagttaccgcacatagagagtccatcaatgatggtctacattaacctcacgtgcgccctgacgaagtaattgccacaaatgtcagtgttttatcgttgcgagatggacaacttggctagcgtggctgttattcggcggaagagcacggaaaattggggagggggaaaacgtgggcacggtgagggtttcagactgggttatgtaatcaaccttgcttgatgttggtgtttgccacactgggaaacgcggacaaattttatatgtatcgtaaccgcaaaagacgcccattcaccggtaagcactctctgcgaccgcagcccttctcactggtgtgatattgcgtcctgtggcagggcatttgcacacccctctcattagggttcacattaccaccgggtaactctaacacaacaaaagagagcatggaaaagggtgcaaagactaaaaggggcgaaaaccacatcactgcacatcctgaggcacacgcactttgcgacgacaagcgaatatctgtcggccatagccactaactggcgtcattctccccccacttctccgcgccccccacttcctgagtccccaacgacatctatcccgttgtggttgccacgtgacggtagttctggaaaaacccaccaccctcactcgacatacgcaactcccctcgactctcccactcttattttcccgccgcgtgaaaagctgaaaagcactccccgacactccatccgacaaaaatagttccgtttgaagcgtcgcagcaacggccagctgaagagacctttcgggtaattgattgtttgcctgaaaaacaccggcaaaaatgtgagtaacccaagtgacttgaccctgggacgcgcgccttcgagtgtgtcctaaagcagagagcaaagagacatctggcggacaagagatctggccgtgtcggacatggatgatgccgccacaaacacgtcgtcgacggcacgtatttccgatgacatgtatcgtcgttgctgtcgactattactcggttcatgtcatgtcatgtctctaaattacgtgctatgcgctgtcgccgacgacgtcgcgatgttaatgacttgagacaataaaactaacccaggaacgaaaattcgtcgctcggggcacaccccgccatgcccgcaaagtcggataaggagcttctaaacgcctacatctatgactatttattgaagcacaacatgcacgactcggcacgcacgtttggcgcagaggccaaggtggtgccgaacgtgaagaaggaggacgacaaggacctgcccaagccgctcatccccatcgatgctccgcagggatttctctacgagtggtgggcactcttctgggacatttattccgcacgcggttccaagggaggaggaagcgtgccagctcaacagtacgtccagggaaccatgcggcttcgtcaagaacacgccgctcgcgcccagttacagcagcagcaccaggcccagcaacacgctcaggctcaggctgctgctcaggttcaaggacaagcccaaggacagggacagggccagaaccccacacagggcccccagccccagggacacatgggtatgcctggtcagggtccccaccagcccggcggcccctttatgaatgggaacatgatgttcccaccgggtcagatgcggatgggtcagctgccgcagcaccttcagcaacaaggtacaggcgtggccggtgccaacccctcggacgactcgtcgtcccctggaggcacttcgcccgccaagagacaacggctgtcgcctgatatgggcggccaatctcatcccgagcagcagggccagcacatgatgggcacccccaaccccaacaaccccgtgttcaactcacaagtgatgcagcagcttaaggcgtcgcaaggccagatgcccaacctgcagcagcaacagcaagcacagctccagcaatattcgaataccttatcgctggcacaacagcgtgctatgatgaacgccaagggtggtcctaacggccagcctggacagcctggtcaacctggacagcccggacagcccggacagcccggacaacctggtcagccaggccaacctctacccatgggctacgaaggaatggaacctggattcatgggcggcaacgggctgattctcaacgcccagcagatgcgacagcaacaagccggtagcggtggcgcagcagggtctggccagctcaacggcaactccaacgcgctgcacgactaccaaatgcaactcatgttgttggaacagcagaacaagaagcgactgatggtggctcgacaggagcagcaggaaggccagcctcgagctgagggccaagccgcagcagcgggcgccaaccctggagctcgcatgagtggccaattcaagcgacccggctccagtcctgtcgttggcaacattggcgacggccgacgagtcacacccaagctgcccaaccagccatcacctctgattgacgccaaccgtgcctctccccttcaaagtaatttcaatggccagggcgacttcaatgttgtggttggtcccagcggccagatgatgcgaatgcaacagccacagcagcagggcggtcctccccagcaacaaggccagcagcaaggaggccccggtcagcagcaaggaggtccaggccaacaaccacagcagggccagcaacagggacaacagggtggcccccagggtggacagcatcgattcgatgatccccagcagctgccacaaagtcagaacggcggtcctcaacctgggtctgctcctgggcagcttccacagacacagggtggtcctcagcgaccaccatcacgggtgtcgcagatgcccccgccgggcgtccaaggtggacagcgaacacaaccttcctcaccgggccaagcatctaatcctggtagcggtggcagcagtggaagtgctcctggaggcacgaccccaacacaggctaacaagcagctcaagggcaagaaggccgaacccaagaagcgagcaaagaagggcaaccagcccgtcacccccaaggcagtgtccgagagccccactcccaccacgccggccacgccgtctgccgcatcaaaccagtcccttttgtcgaaggctaccaactttgccgcaaataacaagcaagctcaggcggcggctcatgcacaggcccaagcccaagcagccgcccaagcccagtcccagatgcatatgggtggcatgggtggctcgtcctctggactggagcttgacgtcaatggcggaatgggtcttgataatgactcgtcctcgttcctcaatgacttcagcaccggaaacgagggcgatgtcggcgacatggactttgacttcaactcattcctcaacacggacgacaacgccgccggagctctcaagtttgactctgggtctgcttttggctggggcgagggcgttgaagccatgaatgagtaagccagtggctgtggcgcgagcctgtgaggtttggttgcctggaaaaggaacgattcgtgactctcgatattttttttgtttagtctttcctaactccccctcgtcattgacggacatcgatctagccgccaacactcaccaagtgccactgtattatacactacctatttatttatacagatgtatatagtcaagtgatgagatccaggtgactaacagtgtgtacaacatgtaaaaagaatgtattttatgttagaggaatgtgtgatgtatttgtatgacacggggtagattgataaaaaacggtgatatgcaacgcgcaccgtatctcgcgtcttagacacatgtcttcaatgcgcgggcggactaccccacctatagataaagagcatatcgtatacagtaacatcccatgtcgcttcctttttgggttgaatcggtttttgtttatgttgagataattattcggatgtcgttgacttcgggttggaagtgtgatacagcatacagtaagtcggtgtgacacagtctgttattacagtaacagtaaggacttgcatcccctgcatgtttacacagtgtttgcctatattgcatgaccctactatcgcttattcgttgtccgtatgataccatacgaacatcaccccacgtccggacgtttaaaggccgttgtgtggcttggttttcgtattagcctgagaccagggccatatcggcgttacagagttcacactgaaaccactactcggactgtcttcgtactcatcctgtgcaccttggtaagtactttactcgtaataacacacccaaactggacacagtagtccgaacactaaccatttaggaagaggaatgtagactctaatagtcggagaagtgaacgtcatttggggtaattacattgtaaatagtttagtaaactgtagagaacacaatccgtcgtggttggcaatgcagccgaattgtcaactgcccatacttcctcgtcactcggtgacagtgttgtgtgctactggaacgacataatattttctggttggaagtacgcatgtacaagtaacggcatgaagaccgaaagtctaatacaaagtacaagttatgtacattccaacgaaaggtgactgacgtatcaccgtctcctttctctcggagtttgtctccacaaactgccttagatatggatgtaaggtacaggggtcgatggaccgaataggctgttgctcaaggttggtgtgttactgtagagccttatcggatgttaaacgctgtgcctttcagcgaggcgacatgtgataatatttgtgaaacacgcgtgaatgggtgttgcatctacagtggccccgtgaaacaagaggagaagtcgctcgacaagcgtagctcttctccgagtctgcccaggcccttgaaagggtaagaagacttgcgtcaccgcctggccccttgattaataatctttgcgtctgtgagcaccccttgattatgtactcccaccaagttcagtgactgcattttactttgggatggcagactgatgacatcagagtgatgaccagacggccttatcagcatgtcgatgatgcgggacaaataagggtgaaaaaagaagtatttgtagatccctacaagtagattgtaccgtgcatatgtactggtaaaagtatcgtacagtgcaagtactgtacaataaaagtgcacagaccggtacttgtacttgtagtacgagttgtacggtattgtatggtactcgtacttgttgttacttgtaacaccacgggtctaaatgccacagacacggactgtatcgttcgcagtgggtcacctctaccaagcatgaagtcatgaagtcatccgcatacatactcattccaaaccattgtgccgaggacaaaatattacagtattatggccactgacacgtactggtacgaaccatgcagacgtcatcaggaggtcaggaggcctgtcataattacatgtgaaggcggggtcacggatttattcttctattacgaagccattttgggatgtctgaagttcccgttctagcttcacttgttcgtgcctgtcggcaaactcgtcccctgcatgtcgttttggacaaacagcgggggattaacatgccatatttgcgccctttggggtagatttgtgctccgaaaagaaggtctcctaaataatttggaacgaatctgtcccaatataggtctacaagccgttttccaccgcatgaagacagtgtatattatttcaaggcgttgtgaaaatcacattctgtctcaccttggttttatacaccctggtcgctctgttttcgtgccattggtggcgtgcatgtagcccttaactgggtttcaacgtctcagaggtatttacccattgtttaatatgattaggcgcatataacataacaggtcagcccgagcatgcccacgtctgtgacctgatgaacggtctaggggtgggccaatgtcacatggagtcatccaccccacccctcaaaagtcgttccaccatattatttctccttgcttattatcttcccaagagtctgcatgcttgttcctctcccgctccagaattagaaagtctcaaccctggtaaacctgcaaccttatgtttaggttctgtttggatctccgctgcacacaaggtccaaacattaggctccttctttttactatataccctttccacaatacttgtacctaacggtggtatcgcctccatatgctctagccgccatgaacgtcatattcgaaaacacgcccatggcggactatctacaacaagcagacaacccggggatggccgactggggcctggacgacgagtacgactttgacagtagcgatgaggaccttctccagagctatgagggaagaaggtcctacgagaaggaccccaacgtggaggaaaacttgcgaaggattgatgaagaagacgagtacgacacagataccaatacagaaaatgtctcgtcgccagagcaacaaccgtcacaacacccgcaatcacacccgcaaaacacgcaacgcaagcacagaagattcgcctcaacctcagctattcaaccgctacattcggcaaacgagaatctcatgaagcgagaacgctttcaactgttgctagccggtgcgctacgacaatcccttccgttggtggagaacaacaggttccttgaaaaattcagatacattgtggttacgtcccagctcctgtcagaacagccaccagtgtccagcaaaacacccaactttcccgacgacaaggaccttctgccggaaactacatgggcgaccagcggcggttgcgtggtggtagtggtgggacttttttcttgggcagttcgtaaaaaggctatcttcgaggggaaagcacgtgccatggcctcctttgtcgccaccttgtgtttagtgatcttcatgtacgcgcattcgcgtcgaagattactgcgcattattcgaattaaggctgttcagtctgctcggcagtttgttctcagttcacagggatttgatgctgctgtacacaagagtttgggtgttattcacgaggtggagttcctctccaagggtttctcgtttcctcaaaagactgtggaaggcacagaccttgacgttagactgtgtaagcagctgcgcgcggctctctcagcctctctctaccttagcatttcctctttgacccggtccatccgtaagatgctgaaccactgtcacaagcttgacctggaaaagtatctcgacatctatgaggtcgatgttatggacctcagtctcttcgttgaagatgatggacccattcccgagcatgatttcacggcatcgtcgccagtcgaggcacttcgaaacatggttgacgttcccgaggccgacttctacggctccaagggtgccaatcactcccacaagaacctcaagttctaccactacaagttccatctgcttcgacgtgtcatgctatgctgtctactgtctatgactgcaagtggcactgatggaagcgaatacacgcagtggaagttggtgtctggggaactgtcccggtctgagaagctactgcggcaactggacgagtcccttgtcgataccatttacggacttgaccatgacgccaagctactcagtcattcaagatcagattccctgtttggcaaagtcattgattcacgaaagggcagacgcctttcttctttcaaccttctttcagagccttcgtcggctgcatcagagccctctaaggaagtccaacagcatcttaagcagctttctcgtctttcctcgactctcagacagattgagggacgtatgcaaattgcccgtgaaggctccatgtctcacattgagagcgcttcagccgacgaactccttactaactaccgtactcttggagatgacatccagtcactggccagcatctggcagggtgggatgtcttctctagaggccaagctcaaaaacccttctacctcccgcgcagaaaagacgctgtccttcattgaaaagcagcgccatctttctgatgccaccgtggatacactagcgtctccgttgttgcagcagctagcctctttaggctctcctgtgcataacaatgactactccacggtatctcaggctaccactcttgccgaatttgaagatgatgtccatggacccgccgccaagcagtcagctctgtccaacacatatcgggcactttgtggcgactcgacgcccgtctcttctccacccatgtctcctaccatgcttgaggacgaaaatggtattcccattcaatactctcagtttggtaaaagacgatccttccatcaacgtgacatgtcgctgaccaccatccttgaaggtatagctaacaaggacaagggaaagggactgggcatcgatacttctggaactgttcatgagcagcgagagaagcgcatcgcccgtatgaaagaggagcgagaacgagaagttgacaatcgtgctgccgctaataggcgaggcagtgtcatgctggagctcaaaacggtcctcgaaaaccgttgattttaatttaatttatttgcatacactttctaagactttgagctgtaggcttcgtagatgagatgtaccgtagattgcccaggtatgaacaacacggaactacacaaccacatgttcactctaaattggcatcttcagatgcccgtaaataacttatatatgtatatacccgctgtatcaaagcaatagcacttttagcaacttcaccttctaccaccttagatctctgactcagacttgatagtctcacccttacacttctcaagaccctctccaccgtaagaagtgagaggtgaaacctcgacaagctgcttgccctcaacaatggcaccggcagccttgacccaccgagcaccctgctcaagaagatgagctctggatgtctcagggtcatcctggccggttccaggagcgttcttaagaggagagaattcgtcagctcgagcaacctcaagaacggcgaacttggtcagggggacagtcacgaaaacatcaaagacgaactgctccagcttgataccgttgggagtggatggcttgaccgtcttgccctcggcgtccacgtaggggatcttcttgtgagcaacgtgaaaggggaggatctgctgtcggaactcaaagttgtccttggagaaccactcgggaatcttgttgaagaagttgatggagtagtagtggttaacaatgttggctgctctcaacttgaggagaccgggggcggaggggtcctcggccttggccagagcatcggagatctcagaatactcgatgacctggggcttgtcgtctcgagagacaatgagaccgacggattcggtagcgtctcgctttcgcacaaccttggtggcaatgtcgacgcctcgagatgcagagaaacccatgaaaacgggatcggcaactcgggccagacagttgtcaacacagtaagtgtggatatgctcgattcctcgcttcttcatatcgtcgaggacaccgctcttgtagagggcaagatagagaccgccgtttccatcgggggcgacagcaaccttgccaggggcgtcgagaatgatcttaccctcgtcagtaagacaagggaagacaccctgctcgaagaagacaacattcttctcgtcaagaccaaagtatttgtgccccttgaagaaggcctcggtaggacctcgagtggggccagaggtcatgatgtaccacggcacgacacctccgctaagctcctggatcttggcgattcgctcagcctggagttggaaaagagacttgtgagaggggagaccaatgtcgtagcatccctttggggcagaagatccgagtcgggttccttggcctccagccatgagcaccacagcgaccttattgtcaccgatgagcttgagaccggcgtcataccactctccagtgtacttgcttgtgggggcgtcaggcagggtagagcccgagtactcctcagggataccctcaattggcgaagtggggttctccatgcccttggcagccttggggatggtgttctcagcgtgccaggttacctcggtagggtcgatctcagccagctgggccagcagagaagacttctcctcgtcggagagcttgtcccagaactggaacacctggccttggccagcgtcatcataggtcttctttagctgttcgtatgacatgttttttgtgttggttgtactcaaactgggtgagaaagcgctgacactaagtattatggcatttgcttctgcttctcaatctaattttagtaacaccataacactggaactctaatgcgttaatgaagcgaagacgtggtctacgtgagcagaccgtgtattggtctagtgtaaggcaagtgagtaacaatcccagattatttggaaaataataactcatgattagttttgttgccaacattttcgacgccttcacgagtgcggctttcccatccagcagctctctgtgcttcagtcagaaacgtgattcctcagcaaccgcacaattttaaacagagtaaatacagtgctttgcatgcacatgtgcgatgtgcacatggcggcgtttgcccgggttttacttgtatactcattggtctattctgagataacctccttagatgggtgcagtcggttatcttctatcggaaatagaccggtttcgtgctgttactacagggctcatcccgctcgctaaatgccagtctctcgcactaaagtgggaaccgtgtgttttgtacagtgttccgtgcatgtaatttaggccttaaagatgacgtggacacacactcagcgtgtcgagacccctgaaaatgacatactacgtgtataatatgtgaaggaggtgtatattttgtttcaagtcccggttgagagacccgaagtccagtgtttgtctaacacgaccgtggtctatctcgccaaccacacgggggttaagggacagtagttccccacctaaccgagctaaattgcttcgactggccatttaggttgcgtctgctgcgggctgtcagtcacttattgtggtcaaatggaacaggtaatgtgattctgtttcgtcttgtatacactgattattctcagaagaagttaggctgtatatgttctttatatggtaagtgatccatatcctttcttaggtgcgtttctcaagaaccggagacacccactaacacattttcacccaacagggaatcaagtaatacttagactttaaatcaattaaatacctgaaatatttacaaataaaactcccatcggaacctctgactctatgacaccccacagcgccttttgctaatattatgagggtaccagctttctaaggcaccgaatcaggctacagataccgtgtttatttttaaccgatttgcttttccaaactactgtacctcgttcaccccatatcgaggctgtttcatccctgctcatagctagccgttgcttcggagtccccaataaccgttttatctactgcacgtcaagcgtactgcattaaccgtcgattcaggataaacagtactgtatcagtatattttctgtaccctcatttggctcaattaaacgaatgcagtatctcaaacggtcagtcaactcaataagggtgtagtttccatattaataatatttctgacacactgttgggcataccgaaaagtggtccacaggagtgaatgtatgatgggtgcaatattggttcctgtttcatccgcatgacgtcatacagctaatattgctgtagattcctgaagcgtcattaaatatcccagggaaagaagagcagcatgggactggacaataccagcgcgcgtaacacgtatttatcaaacaagggttggcatattggttgcttcctcagcaagtcgcaggctagtaagggtggatcgcccctgttcctgcaggtgcctgatagaggggagccgctggaagacattgaaggttcgacgattcccttttcaggttatggttttttatgacggtggcatacgtccttgggtacaagatatgcacccgctactctagcccgctacaaccaagagtgtatggagtagccgtcaagtgcgagctctggactctgttagtttggctgtgtaagatatggtatctacctgatccgtttgcaatttctattgggttgcgtggatgtaatctctattgtccctgcactacaacacacttttacgtaatgtgcgcgctgcactctcttctttgactcagatgcgtcggacataaaaccaactccgacaaacaaacgattatatagaggagaagaccgacaccgaatttgaagggctgtcaagggccatttataccacaagctcccgtctcgcaagaccgtagtgacgtggcggaaattgcgctaactccaacattccctgccgggtaatatcaaacgtcatacggcgttttgggtgaagggatataaacggaaccctggattggtgggggggataaacaacatacagggatgctatttctggcttttagtccgtttttcctgtggcgcaatggaatcgtattggggtgacagtgacgacggctccctaatacatagtgcgacgcaggaacccctcgtttatttatatctaggcctcctggctctccctctctttggagctccacctcagaccctattactgcttgtccatccactcccctacaacgacgaagagaccgaaccttataaatctttgtgtcctgtgaaagcgagccaggagcagaagcgaagctgcacgctgcaaaattccgaattcaaaaatctcagcactcctcacggcagatatcgccaccgacattacgagacgaaattgcactgctcaggtactatggtgagtttgattaccccgcgccaccccggcttagacatcgtggacacggtcacctgccaacgacaccctacgagaccccccactaacacagaactgcgcacactgcaacgccggctcggacgacgacgcctacttcgctatttgcgaggtggtgcacaagatctctcaaatcattggcacaaattccaaaattgacaaggatgtgaccgacaatcttccgggcgagaaaaccccagccaagaagcttctcgccatccagctggaccgactccaggcctccgtccagcagctggtggacgagcgaggcgctctggagcagaacgaagccccctcagccccattttctcccccagaaaactactacactgtcccaacatacacacaagcgtctgtggactcgcttatatcggaggccaagtctgcaggtaaatttgaatcgtcgcaccccgaccaccacatgtaccagttgctcaaggccctcaatgcgaaggtctattcacagcagcgagaaatcgctctgcacagcggtgcagtcgtggcgttggagcgggacctcagccagaccagaaatattctcaattctttcacagaaacaatcgcaccgggcgaaaagcgagtggtggacacagaccttctggaccgagagctgcgaaagtctcaaacagcaaaccgcgcctttcagaaggcgctgatggagattggagaggttgtctttgccgtcgcgcaaggtgacctgtccaagaaggttactattcacgaccaggagatggaccccgaaattgtcaaattcaaggaaacaatcaacaaaatgatgagccaactgcaacgattcgcttccgaagttacccgtgtggccacagaggtagcaggaggaacgctaggaggacaggcagaaggagaaggaacagttggtgtgtggcgagagcttactgataacgtcaacgtcatggcctcaaatcttacaaaccaggtgcgagaaatcgctgatgttactcgagctgttgcccagggtgatttatcgcggaagattaatgtccacgcacaaggagagattctggaactgcaaaagactatcaataccatggtggaacaactacgtacgttcgccttcgaggtcacgcgagtggccagagaaacaggtgtggaaggaagactgggtggccaggcccagatcgaaggtgtcgaaggtatttggagagagctcactgacaatgtcaacgccatggcttctaacctgactgaccaagtgcgaaatatcgccaacgtcactactgctgtcgcaagaggagatttgtctcaaaaggtgtctgctgactgtaagggagaaattcttgatttgaagtctaccatcaacaaaatggtggaccgattgcagaacttcgcgctggaagttactacactggctcgatcagtcggtactgagggtattctgggtgggcaggccaaggtcgaggatgtggagggtgcatggaaggagatcactgaaaatgtcaacgtgatggcatctaacttgaccacccaggtccgaagcattgcccacgttaccacagcagtcgcccagggtgacctgtcacagaagattgatgtgcatgctcagggagaaatgcttgccctgaagtccactatcaacaaaatggtggatcgtctgcaggtgttcgcctctgaggtgactcgagtggccaaggatgtcggtatcgacggtaagcttggtgtgcaggctcaggtctccgatgtcgacggtctttggaaggagattaccactaacgtcaacaccatggcggccaacctgactacccaggttcgagccctggtgcagattactgccgctgctacagacggtgacttcacccgattcatcaccgtcgaagcctctggagagatggatgccctgaagaccaagattaaccagatggttctgaacctgcgagagtccattcagcgaaacactgcggctagggaagctgccgagttggccaacagagccaaatccgagttcctggccaacatgtctcatgaaattcgaacccccatgaatggtattattggtatgacgcaattgacactcgacactgagctcactcagtaccagcgagagatgctgagtatcgtccacaatctggctaactcgctgctcacaatcattgatgacatcctggatatttccaagattgaagctaaccggatgactatcgaaaagattgccttctctctgcgaggcactgtctttggtgccctcaagaccttatccgtcaaggcaaatgagaagcctctggatcttgtctacaaggtggacaacaccttccctgataacctggttggtgactctttccgtttacgtcaggttattctcaatcttgttggtaacgccatcaagttcaccgagtccggagaagtcgctttgtctgtgcgaaaggctgatgatcaacgccctggttcccccgatgagatgatgattgagttctgcgtgtctgatactggtatcggtatccagtctgacaagctggacgttattttcgacactttctgccaggctgatggttctaccaccagaaagttcggaggtaccggtcttggactctctatttccaagcgactcatcaatctgatgggtggagacatatgggtcaagtccgagtacggcaagggttctcagttcttctttacccttgctgtgcagcctgcggacagtggactttctcagcttctggacaacattgcacctttccgaaaccactacgttttgttcatcaacactgagcacgagcaagaagtcgtcgaccagctcgtcgacaacatgcaacgactcaacctcaatgcttgggtggtcgactctctggaagaggctcctctgccagaagaccgatctggtcccaagttcgatacaatcattgtggactctctggaggtagctaccaagctgcgaactctcaaccatctcaagtacattcctttgatactacttcatccctgtatccctcaagtgaacctcaagatctgtcttgatctcggtatcacctcttacggtaacactccctgttctaccaacgatattggtaacgtgctgttgcctgctttggagtctcgtgccgcacctctcaactctgacggtcagatgaagttccagattctgcttgctgaggataacgttgtcaaccagaagctggctgtgcgaattctggagaagcaccagcaccgagttgaggttgtcgaaaacggctatgaggcatttgaggccatcaagaagaagcgatacgacgttgttttgatggatgttcagatgcctgtaatgggtggattcgaggccacagccaagattcgggaatgggagaagcagaatatcactattcgaaccagaactcccattgtggctctcactgcacatgcaatgcttggggatcgggaacgatgcatgcaagctcagatggatgagtacctgagtaaacctcttaagcctgctcttctggtgcagaccatcaacaagtgtgtgcactcagttaaccagcttagaagcttggcgctcggccctacctcgacctcttctgtgaatcagattctcagtcgaagtgggcaacacaagagcgccgtggctgcctcttcttctgctgcctctgcatccatgctaccctatgtggcacctcaacccacatctcccgtcttgtcgccatcattagaggacgccattattaaaaccacagatggcgtcgtgtcaaagagcccacttcccccaagtcagtcgaagcctcgacctaccattgagcagcggtcacgtacggtgacctctgtgccccatgtggattaccccgaaaatggcggcgcacgaattgtcgcaattgatgagggcaccgaacccgagaaagaaagtgaacagcctccctccaacagacgagtaaacagtaattgatagactaatatatttatgagcgatgttacgatgagagaatgtgtaaaaacagtggttacttggattattttgtagagtacaaaaaagttaatagtgtcacggaacagtggacaatttaagccttcttttttttgttcttcgtcttgggttttttcgcagctgacgaagcttttggggcatcagcatcgataacagtctcatctggtccgtccttgagagcctagttcttggccctggcctcgttctccttctcaaccttggccaagtatttctgcagctcattggaagtgggggcttcagtgttgttggctgaggggtatcggcactcagaaacatagacaccgatgatagtgatggcgatgcaactaactgcgattatagatgaccagaaagtgctgggatacacgttccaggcatactcctgaagcgcccaggtgccaaaaatgaagacaaagccgatgatgtcggtgaagaatattctgatctctgtcttgctgagacggccctcatatcgcagggtagactgcataggagacaaaggcgaaatggcgtatgtagctcggtacaggaggaaaggcatagtccagtagaaccatgagtaaaactgatagtggagagatcgagcgaagagcacaccgattaggttacaggtagccatggtgacgaagacgtactcttgggtaaccagagtggagaactgggttcgagagtagaacaggggaggcttctctcgtccttcctgctgagccagttgctgctttttgatctcctcctcctgctcctgcattcgcttctgttcacgcttggatcgcttctgctggacatcaaactggacctcgttgccagaggcttcctgtctgattcggtcccactctgctcgctgggcagcggtgagacctcgtggggcaggaggggggtttgtgaagaacatctcaaacgggttctggtagccggaaggagcattccagatcgtgcaggcgaaaccgatgagtgctgtgaggtgcgtccacaacaggatgccatggaactttcggttctcgaagaccttctgtccaacaaaccgccagttgacagtccatttccacatgaatgctcgagaaaggtcaaaagcaccagccaggtaggaccagatgtgatcaggggagggattgcagaaaggcagtgccaggaagacctgaattccgacgatggaaagggcgaagacaacaagaaggccgtttctgctcataccttggagagtaataagcaggaaggcaggaagatagagcatgaaattcatcttgattccaattgccagggacatccaaagaccggaaagcagccacatctggttctgcagggtgaagacacaaaaggtcatggcgaaggtaccaaagacgtcgttgaaaagtcgaagaacatagatagaatgcagtcgtttagacagacagagaagagggaacaggtaaggtggagcgtcggcgagcagatagacggtgaatgcaaagaactgggtgcccaggtatacagcagcgtagatgtactgggccaggcgaatattctcaccaccagaggtcacgtcgtaaagagcagtgaagattcgagcgtggcctccggggtagaccatgggaccagttccaccaacaattttactgtagtcgtactcaccccccaggatcagagcagcctgctccatgtaggccttccaatcgatctcggtgtatgggaccttgtggatgatggccacgagaaagactgcttccagagcaagaagcacaccacatactgtcatggagtatttgcggtcattggctagctgtagcagcttcagcgccactttatttttgatgaggatcatcgctcagatccaattgttttggtggtcagatttgatggtgatgggagatgtgacctgcccttaaggttgactatacatgtgggggatgcataaatctcggacccagtatccatttatggcgcgtcaatgtgcacatcttatcagtccaacatgacaatcaaaggtcacggagatgtataaatggaaactagcctcattgcctattgatttgggtgtgtcaagttgtctatatatatgtttactaaacagtacgatacacgtacatacaagtacatcactgtaacactttcctgtcgatagccgctcaacaaactcgtctatggatagagtccaatttagctcacaaaacctacttggacttgtagttacagtgcaagtatcgtactacttgtagcacttgaacagtacatacagtagttggaataggtgcagacaggatggcaatcaaattataaaaatataataataataaaaaacaatagtgagtgaaaagagggagtcatgccctttgaatacaaattgcataattagatcgaatgactgtcagaattggtgacatagttaaacaacatatggaccccatatatggcgtacaagtactgtaattttacgaatacaggcagcccatacatttcaaggcttacattttgtatcattacagacgtacgtgagagactttgcaggtttaagtcttaccagccttgttgttatccagagtcttgagaccctgctgaatggcatcgtcagtgaagatcttgccggggttaagtagctcaaggggatcaagagacagcttgatggttcgcatcaggttgagagagacaggaccaacctcgtgaagaagcccctcgatctttccgaatccaacaccgtgctcaccagtgcaggttccctcggcagccagaccctggtcgaccatcttatggacgacgtcggtgacaatatcggcctgctcgggagtgtaaagcatgatggcatggtagtttccgtcaccaatgtggcccagaactcctccaagaagaccagcatcagtgatgctctgctttgccttcatgacaatatcaggaagctgagaaaggggaacagcaacatcagtggtccatgccttcataccgtccttctcggcagcaagagcgaggtaaagcgcgttttttcgggcagaccacagctcatcctgttcctcctgatctcttccgaaatgcaagggagagtctgtgtacttggcagccttctccttagcaaccttcacctgctcggcgacagtttcctcggaggcaccggcgaacttcatgaacagggcgggcttctcttcccactttctcttggcgtaaccggagttgttgacccagatcatgtgctgatcatccataagttcaagagcagccatggggataccctccttgaggatatccatagcagtcttgcaagcggcgtggacggtcggaaactgttggacggcgacagaggtgacattggggatgggctggagcttaacggtgatttcggtgatcagaccaagtgttccctcggttccagcgaatagatggttgaggttgtatccagcagaggtctttcgaggtcgctgccgggtcttgagaatggtaccgtccgccaggacaacagtgagattaacaacgtgatctcgcatgggtccgtacttaacacagttggttccagaacaagagttggcaaccatgcctcccacctgtgctgttgggccgggatcaacagccagaaacaggcgatggccctccttgagaatctcgttgttcagatcaacccagccaacagagggctggacagtggcatccatatcatcgggtctaatagcaataattttgttcatgttggagaagtcgatgcagacacctccgtaggcggcagaaaggtggccctccagagaagtacctccggagtagccgaccatgggaagcttgtgcttgtggcagatcttggcaatggcagaaacctcctcagtagacttggggtacagaacaccaaagggcagagtgtcgaggttggaagaagaaacgttggaccagccatggaattggatatcctcctcgtcggtagaaacgtattcctcaccgatagccttgataaattccggcagggccttcttgaactcctcctcacctccgtacttgggcttgtgagagaagtccgtgtcgagagaggcaccatcgaggaccttctggattcctcggccaacatcctcatcttccttcttaagggccacagcgttcttgtcggacttggtaatgaagtaggtcactcccgcagcgacaccagcggctcctgcaacagcaccccagctgatagatggctgggatgatcttgcctgtgtggagaagttacttcgagccaattgcctggaggcaattcgagagacgctctgggcggctcgtgagattctgttcatggcgaaactggatgtgtgaatgtatcaagaatggaaagagaccctatgccaattcagagtatcggtagttgtagattcgtggcttgcggagtgagtaatagagttgcacagagaggagtcccttacagtaagtcaaaagcgctcagcgaggacggttgtgaaagatcaaatgtcagaaaagaggaagtgtattaaagactagcttgagctatatatcccttcgctgtgactctggttgccccagaatgagacgtgggggtcattcttagtacaatggcgcgagaaagacacccccacttacgtgcatatctatgcaatgtattcccccagaatacagccagtagggttcaataaccggttggtcaaatatatactacttgtagtagacataattgcagttggagaaacagcaacagaagctccccatatgttctagttgattcacgtaatactacgggcaagcgagagatagaaaaatgcagattaaattaattatatgtgacggcgcttaaaaacgtgttgtaagctacatattggaggaatgcaagcaaatccgtcagactagtggcgcagtgtagcagtggcggtgggtgtgttgagtagcgagtggggacgaacacgccggtcagcagtaattgaatgacaaactaaaaccaccccgacggtgtgagacacgggctgaaaaatagctgtgagagcaggggcgtggggggtaaataaacatggccctccaacatggttatgcaattgacaaaacaaaaacagagatcataccagttcaaactagtgggtgatccaccaatgaaatgcttcggtggaacatcgggccctgcaacactacaagtagcatgatggttgcattgcaggtatgcaggcggtacgcgatctgtctcaggtttgaccccccacttcgggggtaggctccgcgttgtttttgacatcttcatcaccaacattggttgagcgactgtgttcgttaagagattcacaggagcagttctcaataaccccggtgttacccttggagagatcaggttcctgacgacaatgcttctctaacattgtacgagcagtctcgtccagagcattaatgtacttcttgaggaacactcggttctcacgaacagggaatcgcaacggagaagagtctgacaaccagaactgaggccgaccgtcaatcttcttgggcgccaaaaatgcaagattgttgtttcctccttcctcaaaccgaacacgggcaggtaaaaccagactagccgtgtccacgtgctcggagaagtcattgtaatgagccggagaaacaccgcttttcttgaggttatgttcaagcttggcgttctccatcaactcatcttcccgttcctgttcaatcatgctagcaatctctccgatctcctcatccacatcttccacagagtcgttagccggaggcgggagtttgacaggtgcggccgagggtgctgctgggatttcaggctcctccgagtgacctctggtttgtgcccagaactcgtgattgtattggggaacttcagatcggttgatctcaccagctccaacaagatggggaactcttccaacgagatgcatcatctcacgccattcttcaaaggagtactttcgaagagggtcctcaatggcattagaaaagacatcattaagcgccttggccagatctcggattgtattgatatcattctccagctcagagatcttgcgcttcacctcggggtccttttctgtctccttgctagcctgatccttagcaccattctccgagtccgtagcagtctcctctcccttttcagggtctgtaggaggagggttgtggctgtaggggttcagagaggggaacgcgagagcccagtcaccgaagacatctgtgaactgcacaaccttcgcgatgacagtatctcccatggacgaaatcagaatagtcatcatgggaacagcagccatggaccagacgataaaaaatgccttaccaactgatgactgagggtacacatcaccatatccaattgttgtaagacacagaagacagaagtacacagcagtccagtaactccagtgttccacaaacttgaagcacatggctccgagacaaaggaaggctccaaatgtgataatagccacagtcagattgagccaagttcgatatttctcagcttgcttgtggaactctcgcatcttttcaaacagttccctttccttctctgggtcaacagtctgcttcagtaactcatggtactccttctttctgtttcgctcagcgtggttccacgccagagtcttcgacgacgagtcgataatcatggatcgaatcgaagagataataagacccagcataagggtaccaatgagggcgtatggaatgatgagggctcgttcgaggttaccgagggggtgaatgtcacccaaaccgatagtcaagatcgacacatggcagaaatacagcgcgtcagggtacgacagatccatgaggtactgaaacagaccagctcccgacgccgtccataccgctaaggatatattctgcaacatgagacctcgctgggcctggtttaagttgaatgttgcaccatagaatcctagcagatgaccaaattcattaaaaaatagcagaatcgaacacgccatgtaacaagcaaacgtcatgatgccatgccagtacgatgcactcagctgcatatcgtcctccagcaacacaaacttggttaccatagtaagaaccaatagcataatcgcagcggaaccgaaaccacatatactgattacctgggaagcagtataattgattcgaccagcgaagttgagaagcatagacatgttggcagtcacaccgatcgcaagcgagacggcattcagagctgtgacccatgcagggtccttgatggtgttgtatagggtacctccatcagattcgggaatgtttccatctctgtactccagccaagcctcggtaagtgctgcgatggcacacatgttagccagcggtccaatcgctgctgcgatcagagggaaagaagatgaaatcatataccatgttgcgaaacccgaggagcccacactgacctccaaattgttcaaatagtcgagtgcgtcaatgtccttggtgttggttacctgcttgagagacattagcgtctcctgggtatcggctagctctgcagggtctgttgtgttgacatgatggtgtaaatggtggggaatgtggtgatggtgttgagcatgcttcttcttgaagttattcttggcgatcttgtagttggttcctccaacggcttctcggtcgtgcaagccccgcttgaaatttttactgtcagggtcgaccttcaaatgctcctctttgggctttcggtggagagggtgaagttttcccatggcggcgagtggttggcagcaagaagagcccagtcgagtggagtgttggagcaaccggcttgtctgcgatgggtgggtggggtagtagtcagtcacctatgactttgcaaggctgatacatgcaatgtttttctacaagcgatctgacatgcaaggtcctgtacgacagagtttctgcctacgacgcgctaggagagggtttgctgcagtatacttcctgttattcccggttgtcaccatctgcgatacgccttacggccgtttatcggcttttggactatatactgaacggtgattgacaagggaactcgtattggtgcacttgtaccgttacggccaagagggggcttggcgcagaatggtaactctactcgtagtgcgatgtctctgggttcgaactcatttttagtctactgaaactgcgtctggggtgtaattttttcggggacttgcactagcgaggacaaggacgtggggcttgaaatggtccaatttagtacttatattccgctccaatatatatttacctctctagagaacccatacaaacgaccgacaagtctccttcaaccatattgcttagagttccataatgtcagatgtttcaaagaaaagcgaaatatggaggtttactttggcgaggtttggcgaagggtagacacgggtacgatgtatgactgggtagcgtcaattatacaaaaatagccaaatcatattcgtacgcgaagttttgcacagaatgaactacgtggctgaaaagtacacaacttgtatgtaggctcccgttgccactgtcatcttccttgctactcgtagcaaattcagagcaacataaaaaagtcaggccgcacccctcatctgacacccacccacacattcgttgaatctaacaggctgtaccgtccataccaacaccagttatttgtaacggtacgagtacccgtactgtactcctactgtagggggtaaactctcgccgtaatctttctcaaaaaatgtcggttatttacgctacctttaattaaatattatctgtttgtagtgttggctcatcacctacagcacaaggatgtacagtagctgtcgttatgcagggcattagacagattattagaagtatcgtactgtacttgcacccatcacccatcacctagggcagaaatgagagatattagcaatttttgttctcactcgaattcaataccaattcatccattcactccaaatacatttcgactctcagtactcgaatttttttagccaggtccatagtagtagcaatccccctcagcagtagtcccagaagttacccggaagtaaatcacgtgcatctacaacctgtatgcacttgacaccaccataatccatcagtgaggacaggatagtggcaatgagcgtgtccgacacagagaaaggcgacaacgccttgaaagaggacaagaagatggaggacaccattgacgacaaaaacaaggagctcatagaggtaaaaccccacgacccagaggacaacaacaacgagaaggagaaggagacggagacacccacacaaacagcatcatcggccgagccagaggccaagaacgaggggaagaaggaaccatcgagaactccggagccggaaaggctagcagcgtcaaaactacagccgctagaagtaacagaagagtacttcgacttcgaacaacacctgatgcgacaaggaatcgcgaagattttgaagggaagaaagatagcgacaacgaaggatgcattttctggagtggcagaactggcagagcaatacatgaacgagatctgcacccgtctggtcagatacacccgtgtccagaggaggaaacagccttccaaggctgatttgcggttaatgatgcaagaatgcgccatccgcacgggagagctggagcaggaaatggaggaaagccgtgagtggcctgtggaggcattggagctatcagatctgggcagtcttccccgtgatgatcaggctgattactatactcgatattttgatgcccgagtcatccccacaagacaaaacaacaagcttgcgacgtatcagaacccaagaggcgattacaatgcaccatggcttccctcattccctccagaccacacatatctcgccactcctcaatacacatcagagatccccaacccacgggtgttgcgtcaacggttggtagcggagggttcgttggcagaaaaagcattgcgaaacctggcttggactgtgcaagtggatcaggccatggtggtccacattgacgagagcgatttggataaattggaggacagactggaggttaaacagaaggggggcattaatggtggaggtgatgtgttttccattctagagaacgacactaacaaggaggttaaaaaggaggatttcggactcggagatgcactgagagatggggtttcacgagtctctactccaaagttggaggagtctgttgaatctcccaaacccattatcaagctgtcgttcaagaaggatacagatcctgatccgtttggtctcggcaagccactgaagccatttgacgtggagaaataccccgaggtgctgcgcaaaaagagactgcgatggaatgaggacggatcaggtgtggtcaccgaagtgggtcgtgctggagcatacggtgcggatctgatggagatcgatgccactggggttgatgaatgctcttctgtattggctgagagcgagaattgcaagcgcaagtcgctggatcagcagtatgcgatggctctgtattccatccagaagttgggcgagagacgaagcaatggcagcagtgctaccgctgatattggcattgttaactggcgaaacgatcggttcatcaaataatttggggcccgaagagatgagtggcaacccatctgtattatatatataatttaagactaatgtcattttctaatcatgttgtgggagagttctgttcgacggtggtgggttcagatctgctcgtacatttgtgctggagtgtctcacttttaagtcaccatttctttacagccttgctaactgtaaatcagtgttgtagattcgcaagatgtggggcgtttaatgatacgaaccgtagctcttaacaacagcagcaaatacagatctcgtatacgacaacacccttgtcgcctctatctaactacttgtaccagtactcgtactataactacagtatttgtagagcaattttaatcttgcatggtgtggaatgtggttgtgcccgcatgaagtgtagtttggcaccaaattaagagaacgagtcgtaagagcacattttagtgcttaaaaaaagcggctggaaaataataacagccgagggaaatagcacgtgaagaaaatggtgatcatgtcaaccacaagaccctgtatagtgctaacgcctttacattatccatgcggctgggttgccactcacgtgatgtttaggttctgaaattgaccagaatatgccttgtttggaaacacgaaggttggacgtcgcgcactactccgtacaacatcacacatcctcacctgttttagttagatatccccacacacaccaccaccacacctcactacaaccacaacatacagctttgtgaagacacacacttttagtcaccaagacaacgagaacgacaaccacgcatagcactacgccagcaagcaacaccccactgatggagtccacaaatatagcattgcctgcctccacaatattccctgttgaggtgacagccatcctcaagggagccggcgatgagattgaaaaatttgcacccattctgaccttcaaatattggcatgaggtcgaggacaacattggcgaggaaaccaacgtcttccccaaaccaccaccgaccatggttcgcaaggagttcttctccaactttgaatcgcccgtcaagggccaaatcgacaactggagcatcaaggttggtgacatgatcgagtccgcggaccagattgtggcggctgttcaggagccttgcacccacgctgtgcaatatggaggaatgtgtgcatggtgtggcgcctctgtggccgacgagaaggactacaccgatttcagcaacaaggatcgagcaccgatcagcatgtcccattcgactgcaggactgaccgtcagtttgtctgaggcccagcgactggaggaaggatcgaccaagcagcttctcaagcagcgaaaactgattctggtcgtcgatctcgatcagaccgtcatacatgtcactgttgatcctaccgtgggtgaatggaagaaggatccatccaatcccaactacgatgccgtcaaggacgttcgtgtcttctctcttgaagaaatgactatggtcagctacgatggaggcaaaccagtgccacaattgtgctactactatgttaagcttcgacctcatctgaaggagttcctcgaggttgtctcagagaagtacgagcttcacatctacacaatggccacccgcgcctacgccaaggctattgcagaaatcattgatccagatggacggtattttggtgatcgaattctcagtcgagacgagtcgggatccttaactcagaagtcgctccagagactgttccctgtcgacacatccatggtcgctatcatcgatgatcgtggagatgtctggaagtggagcaagaacctgattagagtggttccttatgatttcttcgtcggcatcggagacatcaatagttccttcttgccccagagggcaggtatggtgacacccaataagccaccaggcaaggatgaacgaatcgaagagcttgacgacaagaaggagggtaatgaacaagaggacaacccaaccacagagagcaatggcacaaacgaagacaagggcaaggagatcgacaacggcgagtccgatgaggactctgataagaaggagcacgacaagaaggtggaaacaacggagggcagcgaagctgacgagaagagtgacccagagaccacagaggaggcaaccaagccctcatctgcccctgctgagaaggcttcgcctgttgctaacatgctttcgctcgacaaagcccttcctgcagccgaggacgagagaaaatgctcccttgaagctcaacagaaggacagacctttggccaagcttcagtcagacctggactctgcatcttcttcggaagacgaatctcacgaggagcgccaccatctgctagtggataacgacaatgagctcatccacgttcagaaggcactgctcaaattgcatgaggattactacaaggattatgatgaccacgtgaagcaccatgaggacattctgcccgatgttcaggatatcctcagctcactgacctaccctgtttttggcggatgcgtgttccttttctcaggtatcatccctattggtgtcaacattcaacacgccgatatcagtatgtgggtgaaaaagtttggtgctactgttgtggaggacgtgtcgaagcaggtgacccatgttattgctgcatctggaaacaccagaaaggttcgacaagcctcccggtacaagcgcatcaagtttgtttatattagttggatctttgattgcatttctcaatggaagcgtgtgcctgtagagggccatgagattcctcaacaagagattaatgaaaacggcttcagtgacggaggagagcatgtggatgacgatgacgatgacgatgatgacgacttggaggctgcgcagcccttctccctaagcaatatggactggggtgacgagctggggtcttccgacgacgatgaagacgaggaggaggctgatcatgcagatgacgagggatccaacaagcgatctcatgatgaagatgacgacactgacagtctgaccaagaggcccaagactgtcgacgaaaatgacggaggtggagaaggtgacgacgactttgctgcccagttggaggcggatttgttggacatgtagctatgtacatatatttatgagcttgtgattatgattatggattccaggtacgtaggatgcgagacccacctattcgtagtagattacaagcagatcagcctaactatcggtacgagtggtacttgtaacagttcctcataacagtacatacaagtaattgtacatactgtatgttgtagccatgtacaggagttactggtacgtgtaatctgtgcgaaattggtgaccgacgagtttattagtatataatttataaaagaccagctttcgtgaaaattagggggtttaaaagagttgaaaaagaagagaagggtgcataccgaccatttaggcggtagcagaggggccggggatggtggtggtagcggaagcagcctcggcagtagccttggagaggacagagcccagagaagaggtggcagactccagagaggtgatctggtcagtcatgttggggaagtacttctcaagagccttgatgaagagagcaaggtcatccttgaaggaaaagaaaagggtggtggcgatagagacggggccgtcaccgatgaagccaccaaccactgcgataacctgctcggcaatgagcaggtaagcatggacaagggggttaaagaggatggtgccccagaaagaaccgatgagggtaagagcaggggtatcggagaggtggtggacgaagtcgtaaagctcgttgttgatctcacccatgacagcctcgaggttctggaactgggtaactcggtcaccaacgggcttagtgagcaggttgagagatcggtagacacccttgaggacagtctcgatcatgtgggcaatgtcgttgacagcggggatgacgctgttctctacctgctgaggggcaggagcgggggcagctgcgacggcagagaccagagcagcggtgacagcgatagttcggacggagaccattgtgaagaaggtggagttggaggctgtttggagggatggagctggctggcttgaggagttctacataaggggggttaactacctgtatttatacactcatctagatcgactatcatgagccctcgaaagtctgatggcagacttcatgaggtgcttgcttctaatagagttttgaatcaacctcacgccgttgggcaggtctcagaaacgctcctccaatcttaggttaaactctccacggacggtaggggaaatcgcactggtggagaatattggttgtctttaccaacgtcgctgcttcttcaggacctcgtggcttttgatctttaccttgagtggcttttcttcaaagtcttcgttgtcctgctccctatctcgaaacgttaatgctggcttctttctgtagagatgtttggtccaagtcttcgattagccaggactactattgaatcgatccgcaatgttccgctatgtacaatggtagagctcatgcactttgcactccgattgaaagggccacatgtgattccctctcgggccactaacggtctatccaggtacgagacgcacggttatgcagcccaacacaccgctcacggtagctttgagttggttttgcagtgtctgctgaggttattgaaccaggtacaaggtcagatttggatagcgttgggtcagagtgccgtttccattggctggtgaaagcgagatttgagacagatgaattctattcagacgatgatccaactttaccactgggtggaaaccttggtgagagtagaacgaatcgcccatgatgatcagtgataaggccaacgcctgataatagttgcaactattatgattgcgactcataggctgtcagagatttatagctgagtgcggaggttccacggaaaagtctctctctcaacatcagggtccgatgactctttttgagtcacggagccgttcgttttctccaccctttgcgaaggatctggcagcacaaataactcaagagagaagcggaatatgccattagacgcaggtattgtccatcccacaggttatagattgattgaacagctccgtctctataatgcctctgaaaggcattgcaaagcaagttgaaataagggtgttgtagatcaggacgaaagctggacctcatgtgatagtgcccacacatggtcacgaggcggggttctcagatcgatacctttctggtagagctaggatagacagtcgtaaaagtaaaaatacttaagaggtgtgccgttctatggcttgttagaatgttatctgaggtcattcaagacgttcgttgttttcgttttcttgccagcgccatgcctgatggaaatcctaaagtgagataaagtgaaaagtttcaagcaataaacggcaacaacgtcgtcgtcgccctcccgaccattcttacaggcagttacagggacagccctatgtctcatagatcatgcaggtaggccggtctcgttcttctaacctgcatcatggctgtacggccgcgtaagactgtgcccacctgggcggccaagtttccgggtgtcgtcttcaagctcctctggctggaagttttatcagttcctctcgacaaaagcaatacagcagagctgtgtagatctgataccaacagcaggataagcatacatgcgaggtacacacgttcttctattccttccaccgtctgaagttcttgtaaagttccccggaacttttggcaccgtcatcatgtatcgacgatgactcaatcaggaagcaggtacgagatacagatgctcacaatgcccaccaactgagtcctagtgttgtacaagtacgtacatatatgctgccatgagtatgcatataaacgtggggggtcttgtcagcggaattggttgagagcgtattagctatcacaatgtactgtattgtagtttctgactgggtgatttccaacgcagcacggcgctaaattttatcaatatgaagactcccacatggtaacagaacaatactttttgcacatcgcacagtaggctcgttaaaacagacttcgagcccccagtaatttcgacctgcatcgtaagcagcacaggaaccctaatttagtagttgagggtggataaccaagagagagaaacacacccacctgaacggcttgagagacattagtgtgtcagatagggggtggggtcagagaccctggaccctgtcagttttcacaaagccatacagtttcaacggctatagatagttaatctgcttcgggctggacagccaagacaaggcgtcaatatgcccacccaggctgggttgtcacagttttcaagatttctttttgtgcactctttcgactaatccagtatatcgctcgtagtatcgtaaccatggctggattcatacaccccctacagaatgattgcgctttaccctcgaagtcatttatggaacggtcccgcgtgctatggagtcatcttaaagcattgtactgtatttaactaacttaccaactaatcacgtacggatgtacacaagtcacaacgactcacctgggtacagaaacccaaaccctcgagcatgcaagtagcaatgataatgcaagagaaggtctctatccagaactaccaacgccacttaaaaaatgcttcgacctatttccctcttctcgggtgttctagccgggggacttctctaccgtgctgcattctccaccagtgcaattcggtctgacactggaaaccgagttttcttccgaatccgatactctcaggaatttgaccagctcaagacccttcccacacctttgctgtgcaacttctacattcgaaacgatcccttctcgaagacggtgtccgagcgattgaaggagattgtcgagaaggagacctccaacaccgtcaatgccgttgatgtcgaggccgacgaacccgaggtcagagactttatgattgactacggagtcaaccagattcctaccatcattgctctgcgaggaggaattgttatcgataagtacgtgcccaagaaggacactgatctgtctgacctcaagggctgggttgacaaggttggtggaggggacgctcctaagaaggagtaaagctgtaaacacacagactgtaagagccgcaaatacatagagagcggccgatagcatagacaatttaattgattgtaaaattactgatataaaatgattttgatccgcatactatcttaccaggactacttcgagtcaagagccatagaagtacatactataccctatgttgtctgactaagacagaattacgagtacagcaagtttaagagcaacatagatgaatttatagcaacggcaacataatgagagcggcgctgaaaatttcagcgtaaataaacaaacatacatacctaagtatgtcccacacattcaactctttgcgctgttcttataactagtcacgtgactgaattttaaaccaagcctccatgcatatatccacagttttagcagtcgattcaaacgcacattcacatcacacatacatcacaatgggactctttaccaagaccgaagaaaccgcctctgtgggccccgccggaggagataaggacctcaccaagaagaagactcgacagatctgctgggactctcgagacaagttcttcgcttgtctcgacaagcataacatcgtggacgctatcaaggacagcgaactggccaccgccaagtgccctaaggaggagaagcagtacgaggctgactgtatcgccagctggatcgattacttcaagcagaagcgaaccatggaatacaacaaggaacagatgctgaagaagtttgaggaacagggtgccgtcaaggtcgagcccaatgtgtccttcaagtaaacacacactccaccaaccccaagttttaaatcatgtacatattatctattctactgtgaagtatttgtttggtctagttgtaacattgtgtctcataagagaggcgcaaatggatgaatcagaatccgaggtcttaaggcttccagattcgcagctgcttatcgtagaaactacaagtggcaacgtaatcgccattgggagaccaatctcctccatataccatactatcgtggcctgccttgtagtacttgacgattgagctaggttcctcctcagttgcacctgcagcatcaaggataaaggcaccgttgtacatacaacaagtgagtacagtatcgacgttcttggggttgggaagcagtctccagactccaccgccaagttcctgtctcgaaactactgatcgggtgttaacagcaaccatgcctgtctttcggaggtcaaggcaagccagagtatcatcatacgagcctgtccagatctgagcgccatgagactttctccaggaaggcagaattgaggtcactcctgcttggtgaattcggttgttggatatcgtatcggtaacgccgttattgtagtccagttcttgttcaccgtcttcatacagaggtgtccgaagatccgaaatcatgagggcagcatcgtctccaccagacatgaccaagttggggaactcgtctcctccaaaagacgaaatccaagcttccaaagagtgctcatgcagcgagcggtcgatcttgagctcggagtctgagatacgaatgagaacaacctcaccggaagttagagtggctaccatgagatcattgaaagtgggactgaacgtgatagagagcacaagcagcgactcatcaaagagctggtaggacttctgctgagtcagctcagaaccgtcccacctccatgtgatgatgtttccggtactttgactggtgcagatgaaagagtggtcgaaggggctaatcttgaggtccaagattgatgagtttgttcggcagctctgctgcagtttcagctggtcgtcttcaagcttgtagacatcgaccgtaccatttcgacttcggtcgtcctccagcttgtaagtggccacaaagatgatagatgcatcatcaggttgaatctggatggcacatggtggcagatcggtgattgcagacgttatagtgcacttgttgctgtggtcctccatttagtgttcacggaggagaaaaaaaaataattaaggtgcgattatgcatgaatgcgcttatagacctgctcacgaaattgagaaggggatctactacttgtacttgtagtaattttacgaatgtgcttttgtattgtagcagacaagatgactgaatccggcaagataatgagctactcaaaaacgaaaaattaggacggcaccatgtgactgactgacatctcacagaccatcgctggaaagagagaccgttattatatacagcgcctctcacatacatcggctgtgtctcttgtatcgtacagtagcctgtctaattaacgtgattatgtacagcccaagtatcgtacaagtacacagatcagtcagttgatcaagaaaaggggctaacagggccgagaatgattgaagctacagtcttggtgagttcaccccttgactcctattttttatcattaggctgttttacgggattcgtatcaagatgtcatttgctgagacctattcccaattgtattatctcttcacagcccatgaacctacagcaccataacgacacacccctgcctacagtaaagggtagctaccggtaataaatggtaaaaattcatgctctcggctgtgcaggccagtctccatggcgacaagagatccgcgctaaaaatacaactcgtgtttgatggtggattcaacccgaataatggaggcaaccactcgtgacagcgtctgaataccaatgtacattttcaaatctctctataggactcactctacgaagggttcagtaacacgatagacacacgcactcacgtgtccaaagcttgaatcttagggttaggtcaagtttatttgcggtttgtttatgtttgtgtacattgggaataggagacgggacagaacgcatcaacacaaactacacacaaaaatattacaaatggtgagttcagaaatgagagacttgttgcactctttcaaatcatcatggcaccactaacaaagtcgcaaaactccaaatctttcaaggacgccttttccctgttcgacaagaagggcaccggcaagattcctgctgaagctctcggtgatcttctcagagctgtgggccagaaccccaccctcgctgagattgatgatctgaagcagaccattcccgctgagtgtgagtatactacagatattttcaagcatctaggtgatgggccgataatggaacacggtgtggtgtgtgagacgatgaaccgaaacatgtcacggtccagcgaaatgcaactgcgataaattgggcggtttcaacgtgttggggtatagattcgaggaacccgtatcacttatatcgtgatcacaacgtgtttggatctctcgtgacagaaacttgcccgtcaagggatgttccggtgattgattccttcattaaggtcgttaaacggtaacctcgaagcgatcacataagtctctatgacgacaggggagatggggtatgcctagattcgctctttcacacctctaccagcataaatccaccccctccatcagcactaacacagtcgactacgagaccttctccaagatcgtcaaccgaccaagcggtttcaagtctctcggtgagcccgaggattacatccggggattccaggtgttcgacaaggactccactgggttcgtgggtgtcggcgagatgcgatacatccttacctcgctgggcgagaagatgtctgattccgaggttgatgagctccttaagggagtcaacgttactcgagacggcaacgtcaactacgttgacttcgtcaagtccattctggcccagtagatacctaatatattttttatgtttgagcgattcccatccgtagctacttgtactggtgacaatgtctttgaaagtgtcgtattgttttacatagatcataacagtgaaataaatagcttatatatataaattaagcaacctgttgccgaagtatctcgttggaatatcaactcaagatgggcaggaagttgccaacaatcatcatggggttgccaaagacatcccgttttagggtccagatactggatgttttgattttagcaccggtcggtgtaagtagtgtacagtcggccatagtagctcctcttgagtctccaaaagcgattcgagaaaagagctcaaagtactcgaggacagaattgtcgtccagcagctctacgatgaaggtctgctgaccaatgagacgctgttcagaccaacccgagagctgacagaactcttttccaacagcagctagttgaccagtacgtctccagacaagagtgggggttccagaaaacgaaataaacttttgatactctaggagggctcgctggaagcattgttccatgaacaccaggtcctcctctttcagcgagttggtacaggcaataaaagagggtctgtattcagccatatacttagtcatctggacgagctgctgtttgttgaaacggcctttcagataagaaatgagtccatggtatccaggagtgtagctgaatggctttgtgatgttagtatagacctggatagggtcggtgtagtcaggtaagttggagtagacagcttccagagcacctgaagagaagatggacttgcttggcgagtctggagcttcactcccgtttccattgccgttggtgttttgcggctggccagctgctacagcaaacgaaagaggcctcaacttctcgtcagtagtcagctcgctgtccttcacatttcgcctagtttcgttaaacgcaacaatttcaggcacagttaagaaggtatcattgacgaactctccagccagtgggtattggttaagatcctttgccgacaaaccgttagactcaatgagttgtttgatcttagctgagggagtagctgcctggggcgtaggctggtcctggttatgtggcgagtgagtgtttggagactgagagttgtttccgagcaacaaagagttgcttactgcggagtttggttgaccagaagagtacaccatgtttgacaggatggaatactccatattagtagccacggactggaacgagtgtcccgataattgcagatccgagaaccagtctgacgaaaagtcaccttctccagttcttcccaggtctcctaattggttgatttccgtcgccagaagctgctggtgtataaggtagtctgcaggaagttgtgacggagtacttgactggcctccctgtggttgttgggcaccctgtcgctgtggtccctgcaagtttgtgtgggccatgccaggtgttcctaggttcggatgtccattctgaggggtattggggacgggcatattacccatatgttgttgctgcatgttccccttcgtatcagggaagcctgcagagctagagcgagcacttcgagttgctgggctcagttttggttgtacgttcacaccaggggcaggtgacaggcctttactgggcttattatcctccttgtcgtccagatactttagtttcttacgcacaccgtccacacaggtgtctgcgaatcctcgggccacacatctctcacagggtcggttgttatcgcatgtcagatgggttcgttggcagtggatacacgctcggtgggcctttcttcgcttcggcttgcccgtccgttgcgaaatcaccacgggtttctccattggagttgggttggagcaatctgttttcagctgagaatggtcggttggaatgtatgactgcgatgcgtacaagtctttgggagctagagcttgtagaaggagcgtggtaggttgttttcagggagctgacgcgtcggtcgcaagataatagcgtgggtctctccttggctggacaagtctggaatatgagaagttctagagaaatgggttctgacaaccggaaaccgggctgtttaagctagtgccgcagagatgcgggtgcagtgcatatagcttggggtcgaaaggattgataagtggcgatgggagtgttctagttacatgcttcaagagatagtcaggagccgaagctttaatacatcagatacagagccctaatatttcacagacttacacacgtaccagcttttcccaacggtgcaaccccctgctctgttttgttttttcttactcggccttggtttcgtcatttctacttacttgacctgcgtatggctttaagctcaacgctacggaatatggttcatgactagtggggaagccgagtcagtagacgtgaatgttgagtggcttagtgggtcgaagaaggtgggcaaagctgattataactactctggagtgataacaaaacgactgtgctatttcagacctcaacttcaccacatggtcaacaccagcagcactgtttgcttctgctaaacggagcaaaagtttatgcctacacgaaattctatgagatgtggggtgcggcggacgaccccaaatgttgtgccatctgggtgaaaatcccgagagcgagtcacttttggaccggtttgaaagccaacaaaaagactcccctatgaccaaacctcgcattaacgcccctctctacacgctaccagcaaaaaatggatgctctgagctccccaacgtgaaactccgtttaaactcggatgactgatttttcaatgtcccggtacctcccgaacaatgcattctggaggcatctttagcctcggcctctagaggggcaactgaaaaacgcacatgttatttccgatacattccgaggctcctacttctcccgagctccaccgtgctttgttcacgtgcaactcgtgagaatcgaaacgtctgaggggggatgggaggcgtcaggggatatatctgttcagaatctttaagatagctgaagccgacactttggccgtttaaactacactacccgtagtgctcaattgagggtatgattcgcctcttgctacgcgcttgcggtcgaacaccatgtgcaattaattacaagtaggaagcctcggtcaaggctccggacagaggcaaacagagacaaaacagacatgttgctattgatcggggcacgctgacacgctttcaacacttccacaagactttcaaacacgaacctttgggtccgtgaagctttgtacggcgacgtagagtcacagtatcgtagcaaggtccactatgacgtaaatgaaggtcagtgcgatgtctgattcaatgagtcgtacacaactgcccttgaataatgtacaatacgggtagggtatgtgtatttggtatgagtaccggtacggtacgctttgtggtatgagattagagaagttcaagtatcatatgtgtcatagtagttttacgcctgtccatttagcgctccagttacttaataaagctacataatcaaacagtgccagtactcgttctatcatcgtggcaggttttgtaccccggtactgtaaataccattctacaagtagctaccgtacttctcggacaccactatacgatacattgtagtaccagtgagtgagtatgtaccgtacaagtacgcacgatactgtacgatgtcccaacttgagatgtgaattgatctgctgggtctgactcaaacaaagcacacttgcaatgggtagaagcgtttctcgtatacaacttggacgagtgagtcactccgagtgagagccgacagcgtttctgggttaccctcgtcttgtcgggcttacggatcaccttgaatgaaatatgcaacagggaatgcttctattgtcaactgagtaatataagttattttcaaagggggtcgaggaagttcctaggtctatacaatcaatcaacacgactggggagaattcacttccatccattagcccgacactacatcttccttctcttgcacactatacttcaattcacattatcgcgatgcactaacccttgtctcacatgctttaggatcctgaacatgattgagtgtagtgaaactgaatccacgatattatgtgtttcctgtaaagtgcttctattggccagatattctactggcacctatttgtagagtactgtaatctaattaactacttgtaggatggactgaatgctaccctattgtagctacagtatttaagagaacagcctttcctaatgatagatatgcccatcacactcgcatcccatcgaaattccagagtaaaggtaacgcatttggaacaccaaacaataaagacgattttctctttatttcaacgatagccctgaagtttgactggcacaatatatacattggaatacgattagttttagttgttgacacctggttttgctgactcgtcaactaattgtggggcactttactcgggaagagaagtacactgtacagtacatactgtgtaactacaagattctctcaaaagtgccccatgggttgtggctttcaatcgagtacgaagagtatcaaccgatccaactgttccatagctgtggtgtcaatctgagtgtttcttttggatcaacacctctgatatatatttacaccattccaggtcattctttacaatgccttgtagattacaaaaaagtttgttgttgaagcctccaaagtggcttaattttgtcgtttcactcacacgatgagaacaatcagctggttagtgcaacatcaacgtgtcatctcaataatagtatagatgtcagattgagaaatgtcatcagccaagcacacacttcttgctctcataggccttcccatatcgaaggtgcatgctcaatgccgcccaaatgctcacgtgattccacgtttgagtttatgcgaacttttcaaaactcatcatcaccagttagcatacattcacaaaaatgcccttcgatcttctcacaaaggcctttgccaagaagctgaacctttccgagtctccccttactgaggaggagctcctcggcaagctcaacgctgatttccctgctctttccgagatccagcaggccgaacagaaccagtggatcaccttgtccaagcgagttgacgagcccaccaccatcgaccagctcaatgacgctcttaaatccaagacctacctgatcaccgactctgctcaggcttctctcgctgatgcagccgtcttctcggccctgtacgcctctctcaaggagtggaaggaggatcaggtcaaggcacaccgacacattatccgatgggctgacctcatccagaacattggtctgtttgatctcgctgctgccgacaagatcgttgtcaactacaacctcgaggtcccccgagagatcaaggagaaacccaagaaggacgacaagaaggatgcaggtaaggaccccaaggctgtcaagggtggaaaggacacttccaaggacgctaagaaggaggcccccaaggatgaggcccccaagtttaagggcaagcccgatcctgagacccttgctgcccttaaggccgccaaggagaagaagaagaaggagaagaagccccaggcccaggctcagcccgaggctgttgttcccaaccctggtatgattgatttccgagttggccacatccagaaggccatcaagcatcctgatgctgactctctgtatgtttctaccatcgacatgggtgatgctgagggaccccgaactgtctgctctggtcttgccggcatcattcctctcgaggacatgcaggaccgatacgttgtctgtgtggccaacctaaagcccgttaccatgcgaggcatcaagtcttgcgccatggttctgtgtgcttcccgagagaatgaagaccctcactccaaggaggttgagttcgtcaaccctcccaagggcgccaaggccggagagaagatcttcttcgagacctacgaccagacccccgagaagcaactcaaccccaagaagaagatctgggaggcttgccaggctggttttaccaccaacgagaacaaggaggttatctacaagaaggagggcgagcctgaccgaaagctcatcgtcaaggatggccaggttctgtcctgcaacaacttcgtcggtgcatgtgtcagataagtatcttcaataaaacaatgtaaaaaaatgtatagttacgtgaattgtgtagaacgtagacaagaacggcagacattgaacattagggtagctacagtatgtacatacttgaagtggagtgagtagaaacggaaatacccgcaccaaacctctaatctggttcatccgtaaatatagctaatctatatacgtgatgactacaagataagataagattgaactggagttgttgtttgcgtcctgttttggtcgcgccacaggaaactattgaaaacaatcgtctaacatcatgtactgtacctacttgtagtacagctgcgatacaagcagtgatctccgccttccagggtattctctctgaacaaaaaacgaatattacgacccctagagaaatccacacacgtacgtgttgaaggtaatacccggcagggtaagacctggctaattcctcacataatgatgagaagtcatcacatagtgatgagaggaactacttgtagcttggtcgtagacgagatgtccatcctgtagatagttttatccactgatctagaatctctttctggtgaatgagcaagcacacaccagaagggtgtgtgctactatcggaacgtggtgtccctagaagtgggttgtaagttgttaattaactacagtatatctaatcattaatacttatgatcttcaatagtacgaagacgttgtttaggttctgataaccccacggagagagcaacattcctactacagtaaatcagagagttgtgacgtcacgcgatgtctacccagggttaactctagacgatgatagcgaattacagtaaaaccgaagggagcgattagttctgacaaacactttatggagactgaaactaacaacctgctgtagtgtcacccaaatgaccaggcagccaggcagccaccacacatggctacccgccctaattacaagtagtcaggggatcagatgagacgtccacctaaactctttgtgtacagagagactacaagtagacactcttggatgcaaacacgcttcctcaacaggaaattgtgactcgctcaaaacgtaaagactcgcatatcgctgctcacgcgcacaaataggagaatgcttggctacattcgtaagtcttattcggaacgttgagagttgaattcagtggtataatattcagacagttccccaccgtggatttttaggctctgtttttcagagagaattggttatgaataatcatgcccctgtcaaagtactcacaccatgattagcgaactgtagtaaaataatagatctaaggtcgcttgacctatatctgtctgttgctgtgaagcgatgaatgggtttgacttcagatagcccacctacccaccgtgcacacagggctccctttctctcccactcgagtctccctctgcctttgacgtatgtacgatactgctgtcaaacgttttagcagattcgcaccccgcaaataatcttaaggttcgaaagatggagagccaagactggtgccaagaccaggcgagtgcgcaactgaaactttaagaaacgcaaatatgaacgaaggtacgacttgtattaccagaggcgaggagcttgcggataacagatcttggccaagaaattactcatcagggttaattgtgtctagtccgccattctcagagcgcttcccattgttgacatgtcgacttatgctaaaacacacttgtaggggcagtgcaaaaatttgctcgcgcatgttgtttcaattggattggatgagaatccctatagtagataagctctgtgcattaagcgccaaatatgccaggtaaatatcgttcgcggcgtaggcacaaaacaaaaaagcacataagcaaatggcccctttttcgaattatgtgaaactcacacagaaccattctatagatgtgtggacaacacaataggagccagtgtgatagatggagacctaatattatgggcttagtggctggacgctattccttacattgcaagtttaccaatccccctgatccttcgcacatctccgtgacttgatgattttacgagtcttcataccgttaagtggcgacctcagtttcattaaatcagttcacaccccaagtctaaaccataccagcttgcgagacggtagatcaatcacaggagactgggtcttgttagcatatccgctcagtgccgttttcacaaaggtgaaagtgaatgtgtactgttccatgttgctgcaactaaagggtgcgtataataccgccatgggcacaagggatgtgactcgtgccggtcccggtgagatctatggttttctggccaccatggagcgaaagtatgtaattataagaattgaaatagacatgctacgaagttacaaatactgaaacaagtagacacagtacaacgtagtccctgccaagtatgtaccttgaagacatacgaaacggttcgattagatgggacagatgtcgatgaatgggctcttctaaggcgcttccgggtgatgattcacttattgcgcccacctaataatagatttattcgtgcgtgacgcttagatgttccgatgccacccacccggcttctgcgcactgttcaacggtacgacgttttgatgcggctcaaggcattggcctcatcctccagaaaaatctttaattagttccacagtctgttgctatgagcatcatgatgacactgcacagccttataacatcagttactactgtactgtattgtatgggttgtgccgtttcatgcggtgggctatagagatgcaaactcggcgactcatcagccattagcagcttccccagtactacagctagtagtgagtgaggagtcactgtcgccgccactgttgccgccacattggccacaagtacagtatgccatctaaacattgcaaatgtcgacttcagttgattttatcatccacacgtgctatgactaatcggtctgaatggctgatggacacaccaccaactgtggaaaacccactacgagtaggttcaagtagctctaaacgtgagacggctgcatgatcttttctctgcgctaacaaatacatgcggatcaacgacgccaaacctaaattgctgaccgtaaacttcgagggctccacctgtgtctcgtcaatggcatgagacgacagcctgatgaggtccgacagctaaaaataattgtatggttgagcatcaacgccaactgcggaatgccggtgtgcgagagagacgagaaaagtccttcggcatccgaaataatagcttcgcgcgaaaatgtcgcacgccaaggtccccagaaccgttgaaagctggaaacctgccgatttccacgtacaatacaatagaacctgagctaacagtgctgctaacatcgattcaagaacaaggagcactccgacggcctggtctgcagtaaggaagcctaatcgggaagccaaacatgcacgatatttttaaagctgcaatttgaccgaactaaactgaaatacccgacacaggttacatacaagcgtacggcaaaaaggccactagtattgtctccagttgtgggtccttgaacttagctcccttgtcattcctttatggcactcgttatgaagtatagcccatgtcaaagcagtatgtacactgtctcccattggttgccccaacgcaaatgctggcgtcggttttgcgttgtctcgtttgtgtcatcaaccccgttagccttgtcttggcaacttggcacatgcgacattaaacgtatttgactcaaacacacatcccttcgtttttcatttctatacaagcgtttgcggctacatcgctccccttccccccccccccccccccccccccccccatagcgcgggtcctaaaataaaaaaattttttaaaagctgaaacatcgtttttctccaaaagcccctgggaccgtgtatggcccacgggtttgattgggtttatatttttttttgaaaaaaaacggccatcccaatgggggggaggggaaaaggcccttcccttgtcttgtcacttgggcctgggttcccccccccctgggcgagggaggttatagttttaaggttttttagaaccacccccaggggagagcgcgtggggaggaaatttaagcattttttttttttaaaccgcccctttcgaatttaataaattgaagactcagtctatgaattggcgactaaatagatataaaaaaaagaaagaaaaagaaacaaaaaccaacaaaaatcatattaagggggaggaggcgcagtcgaagaaagtctttattttaagctaaagagacacagaagataaaacggagacgccaacggggataaaataacataccgggggaccgattgatttattaaattatagaataataaaatagactaataacaaaaaaagttttattattttctcgctaagtaataaatataagatatgttaatgatgagagcctgaaatattcactcagaggaaatataacttatttcatattaaaacactgaagaagaacatatacgctataagaatagtaataccagaaaaaaaagtcttgtgatcaataaagtgtattaattacagctaaaatatcgtttggattgatacaacaactcaggagactatgggattcaaactcaatataaatatacgaaatatattatctgaataattagattaaaataagtatatcacaacgaaaaaagataaaatttttaagaggaacaaaataaattataaatttacatactaattaagagcttatgatttaaaaaaaaaatataaataaaacgaaaaagcgaaattatactaaattaatagcgtattactcggccttatttagcactgtgatatgtatataagtatcgccagagaatgatagatataagagtgagcgcatagactattgtctatgaggcttgttaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttatttattataatattatatataattaaatataatatataataaattaattttaatattatattttaaatttattatataaaataaatattaaataatatatatataaaaaaaaataaataaaataattaataaaataataatataatattatttttattataatatttatatattaattaaattattatttaatttttaatttattaaaaaattaaaattaaaatataaaaatatatttttattttatttataaatatttatatttaatttatatatatataataaattattatttattttaaagttatttatataagtaaattatttttaaaattagtatttttatatagattaaaattatttataagatttaaaaatttataaattatttattatttaaaaagaaaaataaaaaaaaaatataaaaaaaaaaaaaaataatataaaaaataaaaataaaaataaaaaaaatataaaaaaaaaaaagaaaaaaaaaaaaaaaaaaaaaaaaaaaaaaaaaaaaaataaagaaaataaaaaaaaaaaaaaaaaaaaaaaaaaaaaaaaaagaaaaagaaaaaaaaaaaaaaaaaaaaaaaaaaaaaaaaaaataaaacaaaaaaaaaaaaaaaaaaaaaaaaaaaaaaaagaaaaaaaaagaagaaaaaaaaaaaaaaaaaaaaaagggtggggaggggaggagtaaaaaaaaaaaaacccccccccgggggtcatagcacggatcctaatataaacagatattctaaaagctgaagcatcgttttcatccaatagcccctgtgaccgtgtatggcctacggctttgattgtgttcatattcttttttgattacaaacggccatcccaatggtgtggagggcaataggcctgtcgcttggcctgtcacttgggcctggtctccccacccatgcagcaggaagtttatcattttaaggtttcttggcaccactcccagggtgcgcgcgtatgcattatatttcgcccttgcgtcatttcagacggaccttctcgaattacatttattgagcctcttcgcttgatttcgaccaggatagcagcccatatgatcaaaatgcgtctcaaattccaccatctcgtttttactgtgggcgctgtgctctcggtattgctctttctgagcctctgccccctcacgctcaagcggatcccctcaaattacattaacaccgcagtcgacggctactacttccaatatcaccgactgacacatgtccgacaccgaaagaactggttccgaccctctgtcagaggaataatcgatggctcctttttcgaggtcgactctaccgcaccgtggagagttgcctactcttcaaacaagccgggagtggctcctgctgctgtcacacaacctaaccagcgacccacaatcgtcactctcaacgcaggcgacgaagacagcgacattttggccgcctggaagcgagcctggtatgctgctggtttcaaccccgtcgtacacattgaaaccgatcattcactgcaacacaagatggaggccgtctcgcaagctaatgctctaatcttctgcgacaaacatattataccccttgacttccgacccaatctccctggtggacgaatgaaggaagagttctctgaaaacagagagaagaacggtcatcacggacgaaacagccaccgatggaaacccagcgagtacatgcccgatctgtatgacgacaatgatgtaattgacaagctcaagggaaccccttcgaagacaacgatctactcccagattgaagactctctacacatgggccttgttcactttgagagtatcgagttcatccgagaccttgttcaaaagctctcttctgaccgtgtctctcccggcgaggcctccagagacttccgtgtctccatggagaacactcgagctctggctgtttacacaccagctaatcttgagactatcactggatactcttctcttcatgaggacactgtggccggcatgatatcttcccacaagagaaacatgttctctgctgtcttttctaacggtcttcaggtggttgacccttacgagggtatgagtcagatcttctcactcccctccctgcgacttgctcagcgcctgggagcttgtcccaacgtccctctggccaagacctgtcctcccattgctcccgttctggagtattttaagctgcacaagctcactgagaagtcccacgaccgagaaggtgaggcccagcttgtcgcacccaaatttaacgaggaacacatccgagaactgcagaaactaggatgcatgatctgccaggaccagtcccagatccggcttctgagagcatacaacctgcgaccgcgaactttcaagatcggcacactcgcacatccactcactcgagtcgcggccgaacatgtctccactgatgtagatatcgagatggtctacgactcttccactgcttacgagtcttgggttcacaatgtcactcatagagtcatttccagcgatcgattcggatccgtccccaaggtgctcatgatgaaggatgtcctctacaagtcattcttcgagcaatctaactccatttggctgacctgggaagactcgttcgtccctagctccgaaaccaacaacgatatcgagtaccatctgggctttgttcttccacctgagccggattccagagtgcatgtcaagagtttcaagtccattggtgagggtctcgtgtctcctcatgagttcttcaacaacggagagactatcatgaaggctatcaacgcccgactgcataatgatgatggcaatgactccatcctcaacaccgttgagggatggaacattcctgataccgagatctggagattcctccaggagctcaagtctctccaccgaagaaaccagaacatcaactaagtgacctcatccaagcacttgacgagcctttcgcatacactgagaccgctctgtctctttgtctttcatttgagccacctaatctttacaacgtctctccatcaatacgcgagttgaagctacataagtcgtctatttcagctagctctcgataagcagtcgcctgtcacttccccagtacccccaacatggtcttaacgacatcagcgcaggtctgcaagttgttgcgggacatttccagctcctggtgccgacttcggatccattgaatccctaagtcaattctaggttagttttctaatgcatttatttatcatctctctcttgattttcatggaatcgtagtcagttgtaacgctcgtaatacttaccgtttttcgcctctttgaagatcaatcaggctcatggactcgttccataactgcaggtcgcgaatgaattcctcgaagtccttcattatttcctttcggatcgcctcgtcttgctcaacgagctcggcgtacttgccgcgaatcatgctctcaagctcgttaggaaacatgatctcagggtcgatggcatagttggtgagagagttcctcttggaggacgagcttcaagcctccagaatctgcttgtagggcccctccttggagttgagtaacatcggagaagggtgcgcggcactggagccgggtatcttgtgggcgtgtcgaaatatcttcgtgtaatttaggcgcgagggatcacgatcggtatcttagagggtatatgtttgtgtcgggtgtgctgttgaagcgtctggagtgtagagaagagtgagtgtatatgtaagtgaggggttgtcttataagacacccttaaaacaacctgttggtgctgtacttgtactcatgttgtatgtgtaactattttcccaccttaaattgatgttttgtctgtgttgttaattaggcgagtttgttttggtatgcatcccaaacaatacaccagtgaagcaaactgtggagtgctgtggcgtgattgaaagatatcacgtataaatcaacttcaatataactcgtttacaatttcacaatgatttatatactaccaatatccctttaatctctccagagccccatactcccccaatctttacatagtagtcaatcaaataaggttgtaagtgtgtttggtaaccctagcaaccgcgttggtgcacgcgtctcactacacctctctcttgaacaaattccactcgacgataataccaccagtgcggcaatacaccagggccgacaacaatactacactgcgcgcgcatctccaccactgcttgaacgactgcccacacatcccgcatttgctccaccatacttccatctcatgataccatgccctcgaagggctccaagaaacctaggaagcatggccatggtgcagacctggcaagtgatagcttgctagaccagctgttagccgagtcggatgatgggcaggaacagcgacctgccaagcgtcgcggtattctggcgtcagcgaggacgaagaaggatctgaagaacacgaggactgctaaaaggacaatgagtgagatggcacctagcaaagcgtctcaggagaagcctagaaaggcagcaaggtctcagactattggtcacggtgcctctgatacctcaggcaaacagacgaagacgaatggtaaggttcagaaaaaacatacacaaccatcacaaaacggagacttcaccaaaccgataggtgtactggacatggatgacaacgacacagacgaccatggacgacgatcactgcaacaagagacccagcaggtcattacgcctacagaggtatcttctccaccaccaccagacccagccgtgggcatggtaggaggtaacagtgcggatgaagagctgtttgaggtggagttagagaccgcggaagggttcagatacaggcgacgactgaccaggcgagagctggaggagctacaggctgaggaggagagcacttcacctcaaggggttgagatgatggaacctgagactgaaaactcggaaatggaccccgaccatgtcacagactcgacgtcacacagtagcgttcatgttggtgcccgtccaaaggactcgtttgtgcccatgtcgccaaaagacgtttcgttgccgctcaaacatacaccagtgatacaacaacaggatatgcgaaaagtacctgcaaagacgcccgagcgcaaccacgacaaccggggaagacggattagttctcttgggaacggctttgaaggagagcctcatgcagacgtggatgcgcaaaacttctacaagcactttgagcccggtctgccggaacctcataaagcacggcttctgttgacgtggtctggtaaacgtgcgatgatgaatcacaagaccaggatggttcgtgagagtgctcctcagggtctgtcggaaactgacgagactacagctcgacgcattgttcgtgtaattatggaagacattattcgagacatgaaggacggcaaagtgaacaccagttggtacaatcgacctgagcctgacggtgacgaccattccaattcacggttcaccaagcccaatgcacagaacattgccaatgctgagaaactcgcgctgtttaagaagcggctggctgcccaacaagcagagatcaaggaatgggccaagttggaagcggaggcgcgagagagactggatatggccaagggtaagagtcagaagttagttgcacagcttcaaaagccgtttgattcgccgccgaccctcccttctctgttgagcgatgttgcactatctgcatccacgttttcccgtcagattgaccaggttgaagacgctgtgaacaaaatcaacagttgcaacgttcgggcatccaagttctgcgacgagcagttccaggcgcttgataatgtgttagaatctcgaagcaggaaaagaccaaggcagtctcaagatttcagaaccatctttaatgctgataggttcagggagtcgaccttggacggtgagcagaccagagacgttctcagaacgcttagtcgactcaagtgaaaacattcccatgtggactatttgcattgtgggattgtaacagatgctgatgcactaataattggcatctttaccctggcagttgattgttggattcagcagcactgcgcaggcgtgtactatatatcaaattaatttattacgattaaggactcggcgctttatacttgtaaatactggctaccggttttctaaaatatattgtctcatgtacatatcccttccgttaccctcgtcaaatctcgttgtttggggcttctcctcagtggccatcgagacttgttctcaatgctgtcgctgactttttatcgctgctctccgtcgcattcgttcgtgcttagtcccagccctacagatacttcttggccaagctcttgattcgctggtcgaacactgggctggtgatgggctggtttacaaagtagaatggcgacaataaggtcttgacgtagaggtcgtggacctcctgaaagaactgacgtatcgactcctcatttctggtctcatgcagcaacatgattttgatatctccggcggtcacgaaggcagacaccagatgactgtagaagttgtcgactgttcgcaggtacagctggttggtcctagatgcggtctgctccaccatgtcaatagctgcgtgtagaataaatggtgccagctccttcatttcgggcgagaatcgggagttcccatcacctccttggcggtatgtgccgaactcttgtgtgtaaatggggttgtcttcagtgcccacgattgcaaggtaatatgacatgacgggctgtgtgtagtatgatgtgtgagagagagctgctttgtgtctccaactgaggtttgatggcgcttggggactgtcgttgtgtgattgtagcttgtcctcagtttcagggtgccgttgtaatggtggtggtccttatttcaatgtgctgggacagcacacgcgtaagacgcatgatgagaatttaagcgattcaaaggtgtggataaattccgaaaaatataatttaacgctattgaaataaaatactcattgatatttgcgtaagccagaatcaaaaacattggcccctaccattacaccagacatatctaaaatacatatattcatcatgttgtactagcctataaatatgcctcactcgttataaatctgagggacattctcatagtatcgcgtgcctgtgtaaggacacagggggaacacggccagtagagtcttggtaagataacctagagtcgagggctccaaacttctccagttgagaatcttggatggaccccagcttggtgttaggggatccaggataagaattggcagctgggtgagtgcacatcgcttccatgtgtgtccttctgtagaaacgaccacctcgaggttctgtgcttgagcattcatatcgaatgactcactgatgaaatcagttttcacggttaccatgcccagctcaggtgtaagggggataggaggttcctgttgtcctgcaatctcggtgaaagcactgagaatggcaaagtcatagcctgagagcttcggcgacacgctatcccagtttttgctgacgtagaagagtacaagagagaatagtagtttctgcatctctgggatcagtgtgagatcatagaacgcagagaatctggccttgtcaagctcatctgacaagaagacggaattcagaagttcttccaaagtgccgttggtctcggccatgtgttgggtaatatgttgggaaggagagaggttgaactgagtggcgagatgctcaagataattagacttgaacaccataccagcctggccatcttcatctttgaacagcttctgggccactcttccccagacttggaactcccactgggagctctgcatagcttctccagcagccatggacgacggtctcaaaggaacagcatcatgagagagcgatgtgggagtaatcagaggtacaaatgcgacacgtgtgaccacggtagaaggaatagggaacttgaggacgttggtgggagtgacagcgtagaagatggaaaggaatgtgccatgaggactgatagcagcgccagatatgacagcctcgtaatcaagagtattgaaacttggtgtaacaccgttcaaacttccattgttttccttagctgttgtgagacgcttcatcagcagagccatggtctgttcctgttgctccatggtgttggaagtagggttccagtagacgactccacccttgtatgttacaataaggaccttgtcatcgtgaatagcgatatctgacaccgtgtttgaatcaccccagagaggtgattcaatttttccttctgggctcacccaagtgagtctgtgtggttgcgagacagcgactgttccatttacaaaagacatagcagcaatcacaaatcgggaagaagagatgagggtggaaggttcgccaagctcttgcttctcattatcccaagtaagcttcacgacctcgttagcgtcagttacagctaccagagcactacctccatatggagtggcgtcccatgcgagtttgacaatctgtctgtcacgagtaaaagtagaagctactatcttgagatcgtttgcttcgacagataacacgatgatttcgcctcgaccagttcccacagcgacgtaattgtttttatcgattgttggcgaccatgcaaagctgtggatctggaaactgtagtactgttcgcgggtgtattcctgctcggtaattccaggcacgctgggcgttccggcacgtgagcccttgggtgtgtcttcgccatggtcaatcatggagctgtctccgttggtgggctcttccaccactgtaggatggtcttctccgttagtctcaccagtctcctttttgacgcgtttgtacagcacatcagcaacgttgtggcacagagtccacgagtgcttctccacctggcctcggtggtcgtagatgaacagctcatgggtggtattgagcagaccaatgagacaaccgtgcatctttccgaggcctgttggagaccaagcaatatcagccacgtgccggtcaccggagccgtactggatctggttgcccggaatcgacgtggagcccccagctgtgacggggatggcgtccatggtgtcagacttgttgatggtgaagttggtttcggggaactgggcccagtttcggtctcgcacactgtcaatctcatcgtcacgcgaagtgatgggtccgttgacattgagaacgaccgcgtccgatcctgcagcaatactcagatcaccatcgtccgaccaggccagagctccaccagttgctgagggttggattctcggtaaacgaatgtctttcaacatggtgtgcaagtgtcgcgtatttatctgggagtctgtatcgactgtaattcgatttggatgtcggttaggtgatgcagtaacggtcggatgaggtctgaaagccccgttgtttttcgcgtctgatgtgacgagaataatttgtcgactgggaggtgttgtgcatagcagaagcatcctatagcgaattgactatgacagccatggacatctgtgacttggaggagtcacgggaccgaatgtgggccacaagtagtggagtttgtagattattctctagaaatctcgcccgataaagctcataaatcaaatcctggaatgtcattgttgccaatgtgatgttatgagcatagcgtgtaagatggtgcagagtgatgtcaggtgtagcggcaagtagaggaacttgggacagtggtagtagggaaatatggtcatgtgttgtctgatgcctaagttattcttcattttaggaaacacatccccttcttgttgacattgagtcgtatatgtctttttgtgaaatttacttgaacataactaattagtcgactctttacttgatgatttacttgatgcagattcgtggactttcttcgctgagttgacaagctcattctgaggctcactcccaaccatcaaaccaacacaagaataacccttgctggcccttgagacccgcttatcctccgcttgcatagaaggagtaaagccacccctctcccgtcttctggatgatgccgcatctcccacgcgcgctgtgtagactcaatgtgcccattaacaggagaaaccctacagtacggggtacgcacttggacagcatacgcgtttgtgggttggaaggggctcgtgatgctcattggatgtaagtttcgtcctgttttcaagagtcgctctctttggaatactcgatcgtttacgatgttatagctaagagcaatagagccaagagcatgaatttgaaccgaacaaaacatatggcatgattgctggagcatcgagagattcaagaacacaattctgagatcattgctgataacttagatagatgtattgaaagaagattaatgtcggtgttaaaccatggtttagtggtgccgtatgctcgtgtctttccatagctactactgtatattataacaggttgatagctgctgtagtgaagtcaagcttcgtgtctaggatacgatacgattcacgattggcttacttttttgagcaacgctaattggcatggatccggcctgtttccaaacaaaaaaacttgttccaacaccaagcgcaatatcaatcacggagtaatcacctcacattccgtctgtccggctgctcatcatgtgcgggatttgatgtctgccgctgagctgctctgggtggaaccatctctgcagatggcattcttccggatgcatggacgtcttggcgctggatttttgatttctcgaaaagaagggggagcgcctgttgttaatacagtatgagtaccaacgggtatcgtagagacggtgcgaagattaaggtcgtggttatttcaaattcagtttttgtcggcatcaaacaagccaccatatggattctataggctgcttttgccctccgattcagatgtaccagtgcttagattacaagttgcccacggaaaatgagcaggttactattgcttgggctttcatggtgaagagagcgagctgaatctcagatgttggaccgctttagagggtctgtaaaactctatcgtgtttgtattgctatcccatggtcatcagtcaaatatctacagtattatctacggtttagtaagcaggcacgttcaggctcactacgatgtagcatgcgatacgaataaggtctggccttagaaaggtttatggcgtttgggttcgccataaaataatgtgagaccatggaaggatacgggtctggaaccacagcggttaacttcaagagccaggtaatagtattgaccagggttccacggtctcaagtaaatacggtttgattccgttttagaagaagttccaaaagtgtggccaaaatagacatctgtcttatggtcctgatgttaaccaacacaagtgtagatactcctaccagaagaagaatcccaaagtggaaagacagatatgaccgtcgaagcgagtacgagcccagcacagacaagcagttgtggagtcggttgttttacaatcgtgcgtgatgacacatgtccaccaaaccacatggtcataaataatattgcgcgttgtctggcggttcgccacgctatgtaccttgccacctccatctatagctataatggggagaggcttagtatgcgtcatggcagctacagtagtgtctcgtagcacagccaagtccacacagccgggtggcaaccgtttctttactgtccccgacccgaccgaagcctatcactgctttttccagatcatcgtcgctgccgtcagtagaggagggtgtactaaatatagaattatttgctatcttcaggggcgtttaccctcccaggcttggagcaggcatgtattgcggtactgattagggcgagggatttttttgagttggggtcaaaaacattgcaaacgaggaacacgaggatcactggggctgaatgtagagcgtgagggcatctcttggcactcatcgagacattcccggggatgtttgaaacattgaggcgtgtttacgtgttggtgttgcatttggcattcaagcgcgagtcgtgataattatccgtatctgtgagggacgagtctatttggggacacgctcaaatattttttggaggctgcaaggcctgccgctgttacttggtagaagcaggagtatacacactaccgctgcacttgaggggtgattggagtgagcagtataacgagctacaagtacttgtacgtcgcgtggaggttttaatatgcgagttatccgataatccgaataaatacaatgattcgtatcgtactatatcaaatgtccgtctatagctcgtctacttgtagtttgtcgacgatgatttgaaactcgctaatcatgttatgaaattcaaataggaattgcctaactcgtcgagagggccctttcaccacttggatacgcctgtgttttttttgtcgatcatggtttgctagaggaatgagcacagtgtttttgttgtgccgtagaagccagtacgaccaacagattgctcaagagccacaacgtggtggacggaatatgagcaaaatatctggagatgcaacccacgatattaccactaattagtgcaacgtgtaggtatttgacatactctcgtacccatgtctcgtggaaattacagtatacagacgtgtgaggccaggcttgcactgcagcgcagcgtcttcagccacgcgaagagaatccgtggtgggagatgggcagtctgagcagagcaagaacggaacaagttgatcatggttcggctgttaagttttgtctcccttctggttggggatgagtaagaaagatcatcagggttcgttctaccatcccctctaccagtgttttgaaagcgcacttctcttgggctagctccgcagtaacgcagcccgaggcccctagtacctgggttttctccacaagcgtcatgggcactaattaatttcacaaggagactgagagccttgtccagttcacacaccatggcagtccgatcttagggttcgtctaggttgcaccgtctctgagtctaaatacagtaccctcagagttttgttggcttttttgcttttgcaggtctccctcgttgtcataggaaaaaaggtgtgtgcgagtggcttgtctagtttgcacaatggttcatgactccagagaacaagagcaactgtcaggttcggtcatttgaccgtgattgtaggctggcatcttgctgttttcgttcgccccgcttgaagactcgttttgcatgacgcattccgtggtagtcactgtaaaaagtgggctccgcaaatggctatttttaccacacgtgtagagggatgatgaatccttgttatggttttgtgagaactcgtgtgaattatacgaaccatctcgtttcaaagtgtaagtacttgagcccatactcgtacagacccagtccaaagtagcaaaagaaaaaccaatcgtgctcaaagtatccggggtcaaacacgcctgtctttccactcgccctcaacccaacatgtttaatacatattggctctggctttggagcttgctaatgtaaatcgcatcatctcagtggctattatagaagactcctctatcacccgcacccatccgtctcagcaaagctgccagtgcatggatgaggcgcaattggtccttgaaataagtgggttggtggtgtgactgcacaccaatcattttagcccaccgcgtgaaggctatttggccacatgaaaaaacaggcatgagagacgaatcagcggactcaactatccgatcttggtttgttcgggtggcacacccgcaaagatagacgtgcttcaagattaaaaggaccatatccacattcgtttcagcagaaagggccaaacacaaaagcaacggaagggaacaatctaaaaaaaaccctcacatcacctcacgtctttgctttgcacatccttaaaataagcgcttcgcaacgtgttaaggtgttagtattaaacgcagcaggctgagcaagagtaagtaacaccctaccaactaaactctgacagaacctacttggtgaggtgtgagacaacagaaggatagacagttacaagtagagtgtgtgaaggagccacacaggtgtagatggtggtagccctaggtctgtggaatgagcaccaggccggatgtgcactagtcgggctgtcaaatatcaccggatctcacgtcaagcgcaacccctagcccctaactcctcacccctccccacaatgcagtctgcacaatgcaatggacataccgccgtgcgtggatctgcagctaacctggtcctctatatgcagtatggccagagacacatgaaggaaacagagacatgctttgacttctccatttcacatattaatcttctgaaatactcatctcttctcctgccactaccccgacgagtcgacacccggtaaacgacacccacaacaacatgtcggtagtgaaatccaagccgtcgctgctcaagctgaggcgaggcaagcgagcaggcgacactgaggtgcaagtggttgaggtcaagatggaggatggagacctaacggttatggccgagcccaagagtggatccaaggcatccaagtgcgctaagagcctcagcaatgccgccaaactcccccaactacatcgccagaaaccccacccatcaccgcctggtccagttcgatccactcagtcaccgccaagcccaactacccagacgacccctccgctgacatgcaacaccaactactttccgacgaaacgaagcccgctttcaaacagctcgtcgcccacatctccctcgcatgccgccagtcggccaccgctcaaaccccgtagtaccagcgactcacgacgtttgtctaacgcccttcgagacgattcctcccaaacggcactttccagccacactgcagcatcctcaactctgtcaaggtcccaacccataaactcaaactacgctaataacggtggccacatccaccagtccaactctccaacaaaaacgcataataaccaacacccgcaacccttgcatctccccccaactccgccccttgcacactccgacacaaaagcagcagcgtccatgggcaagttgaagctcacgtcgtccgcgggatttttcctgcccgaaccaaagcccttcgaaaacgaccacgacggataccacagccacgatgacaacaacgaccacgaccacgtgctgaccccagtcacctcgcaggaccaggacccggacctgtcgctggagactgcgctgactcccgacacccccagtagctcgcccgatgagcccggcaaacgcgaaatctcccgtctggcgtccatggtttaccacatcaagtccctccgtaaccagcagctgtacggctctgcagaagccgcagcacagcgaaaccacgaggcgcgtcacttttcatacgactacgacccagagggatcttccaaggaacgttaccagcagcgaaagcacattcccccatctgtttgggccgccgctacaagagttaaggccactctggaagtttaccaccacgctgtttctgtcgcacaaaagcacgtggacagagagtttccagaagtccatctcggatacaacccgttacaggtgcgtcgaaaccgaaaactgagaaaaggaagccaccacaagccctcgctgaacatcaactgtgacacggtgcccctggcttcgtctgtcttttcaaaacacgcacgagactccaaggactacaaatacccctgggaagtggacgtgccggagcttctttcggacatcggatggagagctcagaacaaacgacacatggttgacggccagggcaactacgtctatcctatggcccagcatagacagcatgaccgacgaaagagctgggtgagaatcgccactcctctaggacggtcccaggagtgtgtcgacaccttctcttccgaagaggaacttcgaagagaccaatccgatggctctaacaagctgccttctctggccaagctgtcggacaacgagaaagaaaaagaaaaaagccacagaaacctgggtcttggggcgggcatctctgccgggcccttttccttttctgcaggcgttggaagcatgggaatggcttctcatcccaagctggaatctccctcaaagtctcttgtgagcgtcaaccgagtgaactcctcctctccggagattcaggtgaccctggccacccccactcctccttctgtgcatcttgagtcttctgaaaatgacagtcctcacgaccacgagtcttcagagagctctgttgaaggaggccctgagctgtccaagctgctgtccatttctcggcccgccagcaaggtgccctcttcggccagtctccgagcccctgctctttccatcgtgacccacaatcccgaggtgtccaagacctctctggtcactgccgaccaagggtcgcagctctccctccattcggcccactatgacgatggtttcaacgagcatcttactgagcttcagtatcttgaaacctgcttcatgctgggtcatttgcatatggcttcctctgcatacggtactaagcctcctccctctaatgccgagtttgtccgagaagtgaccgacattatggaagagggctttttccagttaactaacatatacctgccaaaggttggcgaacagtatgacgctgttggtagtgaggtcgatgccctcaagctcgagctttccgacaagaaggacccccttctagactatctgctgtacgaagcagaacatctggtcaccgaggtgagtaccacactcaatctggagacccgaaagacttccgagcgtctcaagcaaattgagtgctgtggagctgctcgggaccaggtctggtgtgtgtgctactttcttctggagtggttcgtcgtccttgtcatgtggttcatttggggcattgtcactgctgctcgcagcgtcaaaaacacgttcgtcatgttctacattaccatcaagtggttattgtggatgtaaaatggcgtcgcattcgacatctatttatttatatatacatatatatattatacatgcatatttatcttctctttactccgccctgtaagtgtgttctgtgagagagtagacttgcctaatcgatgtacagtagtttcctgcatattagaacgaccaatgttacgagcaacgtcgtttttacacgtacagtatgtacgagtgctgtaaccggataactgattcggagttagtcactattggcgaccgggtatccgaatgtttaccgctgaccatccaacatggctttacacattgaactctaagggaaccgtgcattttggactcagtcgaagcggctagaaacatcacgtttttgggagaagttgacatggttgtgtggtatcccaattcaattactcaccaaatatcagttcctgccgcctaattgtacgtttcggataaaaatctgtctccgttgatcaatgttttcttgggcatttcttttgcctactcttttttagtcgcattgaggccaacaggagccccattgaatccgcatgaaatccaacactgttcggaagtttatttaggggtgataatctttggaaagccggctttgggtgatatttcgggagaaataggcagtcatatatatacgtggttgccctatgatgtcacatgacttctgtatctttccctatcacctctctgacaactcgcatcagacaatcctgttcactctcctacctcacccaaccccgcatgacaggaaggttatctcaatagtataaaagcaagtgtcctgaacgtgattgaccgatctctataccacaaggtacaacacaaccacttacacaccacacaatggctcccctccccatcgctcttaacggagacttcagatacgtgcttgcagcctctgccctgctccccgccattggcttcttccactctctcaacactctctactggcgagcaaagtccaagaccaagttccctctcctcttcgctgacgagactgttaaggtcgaccccaagatcgatgcggccaagaagcgattcaactgtgcacagaaggcccatctacagttcaccgagaacgtgaacctgactcttttggccggctggattaccggagtttcctaccccaaggaggctgctggtctcattgctgtctgggcaatctcccggttcctctacgtgctggcctattcgaccggcgagcccaaccgacgaatgccccccaacttcttcaacatcacctcccaggttgctctcattgcctctgctatcttcacctctttcaaggccattgtttagtgatacaggacggcttatgtaatgaatatatgaatgcgattgacaagacagcaattacaatttcaatacgagtatagttcgaatgatataaacacagttaacagtacgaatgacactttcggtagaatgacacacccctatttacaataaatactattagttctcgttcaacagccactcaagcgtaatgagtgcgttcttggttcgctcggcaacatccaaagatggatcacgcagttgcgcatccaacttctccttgtagcccagtttgacaagagcacgagctcgtcgcttagcgccctcacgacactcacggtcgttgttattgtccacgtaggtcaggttgatgaccaaccacgcacatgcagcacgcacatcgtaatgtcgatggccagtgaactcggcaaccttgacaagaatagactcctgctcaatcaacatgaatcggaactcctcggggcccgcagcaatatgggccagagtgtaaatgatggcactgagcatgcgtgtgtatacctggcgcttctcattgacagtcttggcaagcttgatctgtgaagacgagtgagtggctgtgttctcggccacagtctcggtatgctggcgagatatgatatcaatcttgttctcaaggagctgcatgaactcacgagcctccacctgggaaaagaagacctcaacaaagttggcctgtttcatcatcaggttccgtatcaactcgtgggcctgctcctggacttcgatatcagtatcaccgagcaaggtcagcagacgtttgcaagtcaacagtcccattgcctcctcaataagtctgtcgtcgttgtcaggcggcagcactgcgtgtctcaaagcccaggtggagttgagtcgcagaggagtatagtcggagttgacaccagcgataatcgattgcaatacacctcgttcaaaaatgttcttcttaaagggcgaaaagggaagaatgaggttgcacatggacgccatgatggcagccttgacctccagatcttcaatgttaggagactctccgtcctctgtttgatccatgttatcaggctctgcgttcactggttccgagggagtctcgtccagaagctcgatgataccttctacaacctcttcgtcaacaaatccagttcgcagcaacgatacacttcgagaaagagctcgaacaaggtaacatgacgaaattttcatctttcgcaccgctcgagctcgagggtctccagatggaggtgtcttcattcgcataatcttgatgacatgcgacaagaccccacagtcgacaattcgagctctgaaggagtccttatgcattccaatagctgccactagaagaagagcatcagcaatgacttcttccagctggttgcagtggttagagggctcgacttcaggtaccctggaagtcaccagagtgcatgccagttcgatgacacgggcctcagcagccaaggttgccatatctatatggtctcgacagaggagggctagagtcttgcacactcgggggtcggtgtcttctggaccggacagcatgggcactagaacaggtaatagaggccgggcaatctcgagctgttgtgatgctggcatatgcagatgcaggttagaaaacaggaagcagacagccagtcgcacttgggtgtctcctgctcgtagtagcaagaagaggtcttgtaggagacgtccggagctccagttggtgcccgcagtccccacctctccctccagcagtttcattgctaagctgtggcgaaccacatggctcagtgcaaaaactgctgacgccaggggttctgtgtagatagaggggattcgatctctttgggaaagatactgttgggtgagtaaaaggatacgagcagcaaggggttcgctgaggtcttctcctagccgttgcactccagggcgagaacgtcccagtagcggaacaagaggagtgcatagagagacgacgggtaggggtgttgagggcacagaaatgtggtgcgacagggccttgagcagctggggcgagtcttcgatgcattcgtttgccaccgtgtcgtttaccttgagcagagcagccagtgttcgcagcagcgcgctcatgtactgcaccttgtgactgtcagcctccacaatagcagtgacgatgactctgtgtattccgagccgcacaaattcgttcagcaccagcggagcacagccagaggtgaaggaggcgatgatcaccgccgcctgggtgcgcagctcttcggaccagggtccgtcctggagcacctgcaccagagagaccaccactccgtcacattcgaggtagcgggtcttcttttcgtcatggccgataatttcgtttttgagggctttgcaggctgccagctgggcgtcgggtgacagctctctcaggttgcatatttgtgccaccagctcttggtcagcgacaggtagaaacatggctgagttcgaacgatgcctttatgcggtatgagtagatatggtggtgcgatgcagcaacgaaattaacctaaagtggggatgggatgggatgttggagagaggggggtggtacagtatatgagcctcctacgggaatgccaaactgtatcaacccgacaagtgaaaagagaaaagactaatgtccacaattttgtgcctgctgataactccaaaactctcctgttgatattattttcctgtcgtcgtgtatcctggtccattgtggttgttatgctccttgcgacttgttacacagtagcaatggtagggtgtacagaactcacacagtgtgcgtaagaggtgatatcgtacaatacggtacgggtatgagcaccggtagtacctagtatactgtgtacgtacgtacaagaatcgcacaaatacagatacttgtaaccctgacagtgtaacacaattattcggtagctcttgtctatgttgcaaacttgaccgctttcttttcattcccccaatatgagaccaagcgaactacagtacatactgaaaagctgttcagactcgcagtcacatgatctgacgtctctgataattctgtggggggtgcacgggaagagagctgtattttgggatagatataaaagatgaaggctttgctatttaatgagtacacacagtacatactgtacggtagctactgtacttgtacaatactttgtggtgtgccactgccatacctcactcacctctgcatgcatcgtcctgtatgtacagtaagcaggtgcatacaaagttcagtccaccaacatcacacctaacgactctaaaaatggcggtcacctcgattgccctgtataccctggctgtgttgctcattgcccacagcggctactcggcctacgaggcctcctacaatgccaagttgatggcccagaaaatagccgttcccattgacgtgagttcatgagaccaacgaacagacgacacaacgactaaaacgactaaaggaatcaacgaagagcgattgaatgactcaagcgattgaattacctaacgccgatcgactgtccgacttattgcccgtctttacccccaactaacccagatcaaaatcgaagcgcttattggtgtctttctggcttgtttcactccggtgctcagcatcgccggcactctgaagcccgtcaagttcgccgatgctgcttccgaacttgagctcaagggtgagaatcccttcctgtatttggagaagcggtctggtttccagacatattcgggcatgattgagaacctgcgagttcagcatttggagggtcagaagacaaaatagaatgggaatctgtgataatatattgataattgaataatgatggatgtacacggcttctagataatcatttagtatgttacgttgccggatattggttttgagagatgatgtgtacgtaatcactcgtgcatggtcagactttactaaccatggaagcttctgcaactgtaacatcggaattaattaagaattgaaacaagaaggtgtagtgattacaattttgtaatatgagtcaacagtggaattcataaataatgcgaccgtaccgacgtatttaatgggtcactaattgcatcatacttctatactgttctccttctctcccacctctgatccggaacgccttcatgcttgcactaagtttcaagtatcagtgcagtgcataaaaaattattgagttgggtaaacttcagatctatcttcatcacaactacaacacaatgtctgctgtgaaacgagcatcgaaccattcgacgttatcgcagaaggtgtttgtgcgaacttccaaggccggcaacgccaccaaggtcgttcgagagcaataccttcgagatgatatcccctgctcgtcccagggctgtcagtactgcaagaacaacctgtatgttgctgacgccactggaaagcgacaagagcccattctcgagacccagcctaacaaaactaccaagcgtggcccccattacctcgttgtcgacacaaacattgtcctggacggtatcgatctgctggaaagtgacaagggcttctatgatgtgattgtgccccagattgtgctggaagaagtgcgaaaccgatcgctgcctatctatgcgcgactgcgagccctcaccaagaacgacgacaagcggttctacgtctttcataacgaatactgcaaggacactgctgttggtcgaaacaagggagagtccatcaacgaccgaaacgacagagccatcagaaaggtgtgcgaattttacacccaacatcttggtaaggactacaacgggaccgcgcccgaggtggttctgctttccaatgatgtcaacaaccgaaaattggcaaaggaggagggaatcactgccctcggtctcaagggatacgtttccgagcttgtggaccccggccagctcatcgatatgatccctcagcgagctcttgaggaggaggagggagccaagcccaagagcggcaagtccgaggcgctttaccctgaatactaccccatgtctcgacttctaggaggaatcaagaacggcactcttttccagggaaacctcaccatatccccttacaatgttctcgagggttccgtttccacaaaggcgtacccaaagcctctcttgattcttggccgacagtctctcaaccgtgcattctctggtgaccaggttgtcgtggagcttcttccaaaggacaagtggaaaactccctccacgagtgtgattgagagtgaagatcttgctgccaatgagggcggtgaggagagtggagacaccgtcatgagcgagtctgagcggaaactgctggctgacgatgccctcaaggcccacaagaacgaggccgatgctgctgagcgagtccagcctaccgctcgagttgtcggtatcataaagcgatcttggagatactacgttggtcacattgctcctggctcaatcattgatgacgtctctcgaggccctcgatctgttctggttgctctcatggacaagactctgccccgagttcgaatcagaactcgacaggccgctgctctccagggacgacgaatcgtcgttgccgtggactcttggcccgctgactctagacaccccgagggtcatttttgccgagaccttggtcccatcgagtccaagcaggctgagactgaggcgcttctgctggagcacgatgtcgaataccgacctttcaccaaggctgttctagactgtcttcccgccgagggtcccgactggaaggtcccccaggatctcgtcaaggaggctgccgagaaggatcctcttgttgccaagcgacgagatctacgacatctcaacatctgctccatcgatcctccaggatgtcaggatatcgatgatgctctgcacgctcgagttcttcccaacggaaactatgagcttggtgttcacattgctgatgtcacgcactttgtcaagcccgacactgctctggatcaggagggtgcttctcgaggtacctctgtctaccttgtcgacaagcgaatcgatatgttgcccatgctgctcggtaccaacctgtgttctattaacccttatgtggagcgatatgctttctctgttctctgggagatgactcccgacggcaagattgtcaataccgatttcacaaaatccatcatttcttcccgagaggccttttcgtacgcagaggctcaggcgcgaatcgacgacccctccaagactgacgagctcactgagggtatgcgggttctgctcaagttttccaagcagcttaagcagggccggatcgacgccggtgcactgaacctggcttctcccgaagtcaaggtccatattgactctgagacctccgatccgggagaagttgaggtcaaggagcttctcgagaccaactctctggttgaggagttcatgttgctcgccaacacttctgttgccaagaagatttacgaatctttccctcagacagccatgctccgacgtcacggagctcctcctgccaccaacttcgagaccctcaacgaccagcttcgaaccattaagggtatgtccatctctcttgagtcttccaaggctctggcagactctctggataagtgtattgaccccaacgagcccttcttcaacactctggttcgaatcgtggctaccagatccatgctggctgccgagtacttctcttcgggttcttatgcataccctgagttccgacattacggtctggcttccgagatttacacccatttcacatctcccattcgacgatacgctgatgtggttgctcatcgacagctggctgctgccattggttatgaacctctccaccagtcccatcgagagaaggaccatatggagtccatctgtaagaacatcaacgtccgacaccgaaacgcccagtttgctggacgagcctccattgagtactttgttggccaggcactcaagaacgtgactaaggaggaggatgccatccacgagggttacgtcatcaaggtgttcaacaacggtgtcgttgtgcttgtgcctaagtacggccttgaggctctcattcacattgacgatcttggagatgctgagactgctgtcttcaatgagaaggagtacaagctcgacattagcggtaagtccatccgagtctttgacaaggtcaaggtcaaggtggagtcttacaaagacaagcaggagaagcgaaaggtgaagatggttcttctttaggcatttgcatagaacatgtattttatagataacgaattggtatttaatagttgacacacgtgtagtagatgtagcagagcaagtcggtacaataatatttataattacttgtaccacatcgtacaagtaagtaacgcgttgcgatgtacaacaagtagatcatcaaattggctaattactctagtcgcacatgacatcgcgtatcaaaacacgtcacacaagaaatagtgttgaggactaatgtcatgaaagtagtaacctatagtatgtacaagtacagtagtcctattttgggtcgttttcagtaaaaatttcgccaaattaaaactctttctttagcttcggttgttcagaagagcgtatggcgctctgagtcatcagtctgcttagtcatgggtctgggttctaacaaaatcaaagttttccagccttcgtggccaagtggtaaggcgcagcactagtaatgctgagatcatcagttcaaatctggtcgaaggcatttttttttccaaccaccataatgtattttttttttgtgaaaatgatggtcgattgtgtctacttatacaatataagtacttgtactttacatttttatagatctctttattatgaaacttctcccaatgtcattttccaccttcaattacatactacaagtagtacatacaccgttgtacagtatacaccttcagttatgaatgcacaagatatgtgctcaactttttgtacaagtaccccccatttcccaattgattttcctgattctcactcccgttcttatactgtacttgtacactcttatctacttgtacaaccaattactacatcgtatcacccacgctaaattagctacccgtaacactaatacagtcaaaacgtacaggtatgctccataccactgtttctatgagattaaatacttagtgctgctggacgacaccactctcacttgcgtgagaaagaatgtacttcttgtagtccttgatggttccgtcaaactttgagacggttcccttctcggagacccagatctggttgcagactcggttgatcatgtcaacgtcatgtgaaaccatgaggatacctcccttgaaattcttgagaccgtcagccagagcgtcaagacctgcagtatcaagatggttagaaggctcatcaagaatgaggatatgggggtaagaaacacagagagaggcgaatgcaacacgagacttctgacctccagaaagcagagcgagcttctggagaccgatggaaccagtaataccaaaagaaccgagatgtcgtcggtactcctcctcggacttgccggggttgatcttggcgagccaagcggtgggagtcaggttgaggtccataccgtcaacgtggtgctgggcgaagtagccaactctcagacgagggtgcttagagatggatccgtcaacagggctcagctggtcagtcagaagcttcagcagggtagtcttaccgcaaccattagcaccgacaagagcgattcgggagtccatttggatatcgagatcaacgtccttgagcaaaagtcgctcagggttgtaaccgaaggtgacgccctgcatctgtagaatgggaggcgagattttttcgggctcagaaaatcggaactccacagccttatcctcctcgggcagctccagaatgggcaacttctcgagcttcttgattcgtgactgggcttctgaggacttggccgcgttgtatctgaatttgtcaatgaaggcctgcagatgctgtctgtaagccatctggttctcgtactctcggatagcattcttgtatcgctcctccttagtggcatagaaggcgtcaaagttggcgtttcgatagtagtcgagtcgctcggagtgctggtagatgatatcggtggcgacttcgttaaggaaggctcggtcatgggaaacaacaagaacagtggaggggtaggtctggaggtagttggcaaggtaggtgatcgagggaacatccaacatattggaaggctcatcaagtagcagcaagtcaggcttacagaacagagctcgagcaagagccagacgcattctccatccaccggagaaggagtttgtgggatttccttgggtggcctgggagaaaccaagacctgacagaatggcagcagctcgagactcggccttatcggactcgatgtcgaccagcttggtctcgacctcctcgaggttggtctccaggtcgacctgctcgtcatcgagctctcggatctcagcactgttgtcgtccagaccctgctcagtgagggtctttcgttgggcctcaatctctgcgattcgagtgacggcagtgtgctgctccttgagcagatgctttcgccacacatcggcgtccagaacggactggattgcagaagtctcgtctccagtgatttcctgctcgacgtggagaatagtaatgtgcttggggacgggaagctctcgtcgagaaagagctcgcagaagagtagacttaccaataccgttctgaccgaccagaccgtatcgtcgaccgtaagacaaagtaagagaggtatcggacaggattcgctgacccataccgacgtgcagatcaaagttgtcgatcttgatatccttggtcttaccggcaccagccatacccagatccagagggttaactgtgaggaagaactcgtcgtagtccttgctgtcctgggtctcagtgacaagcttggaggcctcatactggacttgggcagcgtccttggcagctcgagcagccatcttagcggcaatcttcttctcagccttctcgagcttcttcttgtcaactcgagactcgacctttcggccgccaacgtgatccagatcagcaacaccaaagatgttgttgttgagcacactggcctgtcggttggaggcgtggttaacggcagacatgagagcctgctgatcgatgatctgggactgggcagaagcgccggcctcattgatggcctccttctgaagaacagtaaactccttgagcatgtggtcgtagagctgctgagcagcaggcttctcaacaccagctccaacaagcagagaggcgatgaaagaggcctcagctgtcaggtcatgctggggaccgatgttgttctcaagatgtcgaatgtagccagtggcgtagtccacaaccacggtgtctacgtttctcgcggtcttggtgacctcagcggcgattgaaggcatctttgaggtgtgaggttgggttggtggttcagtataagtccttatttgcctttatttgcattaacctggtgatgaaatttccttggagcttaatttgtatacagactgtgagtacggagcaatgctgatgtgtgtgtaggcaatggagtaaggagaacaagtggcacataaaaacaatttcaagggacatatctatattttaacacattcatgacctatctaccactcatgtccttctcgatttctcctcacactacaccaagcccccaaactgcatgtcatacttacatatagatggaacactggatgtgtcgtatcatactgtatcgtacctacttgtacactgtagctactggctactgtactgtaattgccatatctatacagttacttgtctgtggaccaaataaaaaaaatcattctattatatttccatgcaacatctactgtactgttaatcactcgattcttggggttcgtgcaaggtactcaagaatgctgttgccccagagcatggcggctccaatagggccggggtgaagatcatcaaacatgtactggttttcggggatggcacgcacaaagtcgcccacgtgccaaaactccaggcccatctggtccattacatgcttggctgcggagttgagctgtcgcaccttgttcgaatggaaccggttgtgtcggtccgaagtgccgtcgttgaagaaggagccttgctgtgcccgaggagaatgcatctgtcgaaagacaatacgggagttgggcagaatcttctgaacctccaggacaaacttttccaggttaaccacgtactcacgcacctgttcctcggtgaggtagatggattcggtaatgcctgcgtaaccgtccagacggtcgtatcgagccagctcccagaaacccacgttaagaacaatcagctccaggtcgttgtgatgaggccgagagttgacgatatcctttagcagcttcattcgttcccaaactcctccaggaagcagatatgacttcttcttgtcatgccagatttcatcagtgtcgaaaccaaagaagaaaaaggtggataaggtcatgttgtattcgggagagtagcagtatcgagggtgacctccagacatctttgcgggatcagtgacctcgtctgtgtagtccttctgataggtcaccttgacatcctggccgatcatttcgcacgagaaggcggcgttctgtctgtcgaccgagtcaccaatgaacagcacagacttgtctctgaggtcagggaaatccatgccgtctctcaactgaagaataggaggcgggtgaatggccttgcagtcgtcattgtatccgacccagtgggtgttgttgaagttgttcttgtcgtagtcgatgtaaccaggcagagcgtaggggtcgcagttgactcgggtgcctctatacacgtctggcgacgaggtcgatcttttgggggcgttagcaatgtcgtaataagcagccttaacggggaattctacagcctcgtcatcgtgcgactggttggtactgtcgagttcagtgtggccttccttggacccactactgctctcgtttgtgtagtccttgctcttagggatcgcaaatgtcggtgaggggaaaatgaagaatcccatgagcgtaaagagaagggccacgaatgtaatggccgcaataatgcggaaccgtattgccgtcatttgtaacgagtgtgtgtcggtttgagggtgtttcagatcgcagtagtgataaggagaaagaatgagctggctttaaacttctgtatgttgggtgtgcgtgcactttccacactcgctgtacctgaatcaactaagccagtcatggacaaagtatactggcagcacagctgtgtacgtttatgtctgctttcctgtctactcataccaaggatgtgccaaggcgcgtacatgacaggtcggagtgaaacctgtgcgtgaatacctcatctagtggacacgatattctcgggcttttacggtgtacctgatgagcacatccgctgtgtcgatctcacatggggctgagcatcgtgcagtcaccacgcacagtggacctgtactggacgtggagtacgacgtaccccccggctcactcaatgtctacaggggagaccacgcgtctgcatcccaagcaggagacgtgtcatgactggccaggggaagaaagatgtggctaagatagggcggcacgcgccctaagctaacagcctaaatggtcccttgaaactcttcacaataaaatccgcgcgtgctttaacgctctggagaagggggggggggggacttttgaaaaaaaacaaaaaaccaacaacaaataagacacacagggcactgcgcacaatgcgcttgttggggtccgtttgcttcatgaaggattttcacagtcatcgtacgtcgtttttttttcttctttttttttctgcatattgtgcatggtttcattggaacgatgacgatggtttgactagagagtcaactgtaattgttgggaggtagttgatgaatggcatgggaaatatgtacaattacagcagaggtatactgccaatgaggtgtatcgacaacgtattgaagactacagtatggggttattccggcataatttaatgacatacttgctggaaagatggacaaaaaaaaaaacaaaaacagtcagcacaatagctgttagttctccattggagtatgttaactatgggtgtttttccgccagtttgatcctgagctaccttgggctcggtacatcccctggggtgagataatgaaatattgccttcaaacggtccagtaaactacaagaaacagttactgtactaagacagtctctaactctttatattcaaaagttcaggcgtcttcttccatgaacaccccttgcgcacaagaagatgcccatggtcagcatctgttccatgtaagtttaggagagcccatagagagcgccataagtgtgtaacctcaccagtacatatggtactgtggcggggtttctctgaattcactcgagcttctagtgctcgtacacgtataacccctttctctactggatgcttttgactgtactctgtgtggcttctggtgtgaattatcgagacaggtggtacatactatacggttttaagtacagtacatgtagtctccacaccgtccagatgtccaagcgtacgaatttgcatcaaagagagtgtagaaccgcaggtggcatctacctgtacaccgacgaggagagctgaagagaagagtatgtacagtgctgtactgcgactgtcacgtatgaatatggtcttcaattggtttagccaaacagtgtctgaaggtgagcgacacttgtaatgccaaaacataacacggactgggggttaatgtgtgctattcatcaattgcgtagttcgagcgacccggcgacgcctaattggtaattctaggctttctaattctagaacgagagctcgaaaccaacacagtgtgggtttctaaaaccgactgtgcatcagccgattccggggttacatacatgtctggagcatgcataagtaaacgaaggctattatgaatgaacagtctagagcaggtctaaaacctatggtaccgggtcgcagtgtcaagcctcggggatgcaaaaaccagcccaacagagtacaacataacaaagactacaagtaggtgcattcacaaaacaaaccgcatgatcatgtaacaccccgctcacttttatagctacagtatcgtcagaatagagtctccgtctagctagagttacgtttgacccgccgcacaaccccggacactccacctggtgcctgttgtgacacacttctgggcagtaagcccgaaaaggctgctaacaatgaggcggaagtgtcgaccagttaatgttccgagcggggagcggtgcagctcagtggttcagactctctaatgagtgcatttattccactcttctcttcaccctacaaggacggcacgatcattacttgtatccactcagcccgtacaaacgcttcagtatggattgatttatcgcagctacccataagttaatgcagtaaggaatatacccgtactgttacatacaagtaccgtatttccacttgaattggtacgacaatcgttcatatctcagtctgctcgcccaggttgtgggacagagttttcgcctgactgagccgcaacctgggagcactgaatgccgaacatcgttgaacatacgtaacacgagacagatcataaacgagctgctcttctggaatgctcgcatccccgtggggatgcattttagacgaacgacgaattcggatcggaccggaatactcaaaacagttgcagggtcacgccatgtggtgtgagatactttgaaacgaggggatatgatgcctgtgactgctacgtgaggggtaactgatggtccaggcgagagttatattgtgtagcaaagttgactggagtgaggaacgtcatcagacgaactcttcagtacaggtacagtctctatcgtagactatgttcacccaatcgtatagtcgattaatagacactcagccttcaactgcttgttcattaagcatagcgcccacagcaacatctttgttatcctcacttacttccctcacaaacctgcacccatagagctcaaaagtatccactggtgcctcaaaaataaagtacttgtacatcaaaaccctttgatggtgctcatttagacgcggatgtccccgggacttccgaacgctagcccacgctacgtccggaaagtacagcccatcattcagcttccaaccgctggaacgtgcagtcacgtgatatggcaccatctgcacaaccatcatttggtttttcattttcatgcaagagtctgatccgttcctaattacttgtagaactcttcgcgcccattccttctttggtcgtcagcatcggaaccttgaagttggcgacaatgaaaaaaatttgtgcagtcaatttaaggtttacggacgttgtcgctttaccggaaaaacatgaaaccggaaaaactagacattgtcggaaaaacatgctgtggttgtgaagggagatagaatacacacacttcacatcgtaattaaacactatagggatgcagatttattgatacacagagcaatcagaaggaactgcagggtctgatgtgccgataacaggtccaagtgctctacagtatgtactggcggcggtggtgtgcatcacatcagacaacctgcaatgcacattcttgtactgaagtgagccatgcaaaacaatgtgttgtttaagctgagctttccatagaactactggacactggtgctattcagttgtttgccaccaaacacgggccattgagtttcttttcgtattaatagctgggcattgcctcgacgcaacgaatgaactctctcatttttgacacacaacgtttttgaagatgcagctatttatagctcgtgtcgtaaatccttgagccactgcacactttaggcagtcagatacgccaggagtatttctatttgctctcaacaggcttccacctatagccggtagggcttatctgagctattaacggtttttgcaattcttcaatgcatatggacagatgtgtaaggggggggggggggattagaaagtctggacctggtaattaggccatgaatatgacacgctcttagaaaccacgtgtcttagatggatagatggatggccgttggcatgacatgtttttagtccacatgatgtatagttaaacaactcaagacagtctaaaaggagctactgtaaacagtcgaaagtgtacctaagcgaacacgacttgtacgcttttgtaagggacaatggttttatgttgagttgagtcatgactcaattctatcctcattaactcaggagatcggcaacctaagttactattacgggcaagaacttgttcaagggttcatgctatgcaatgacccccacggacaaccccccaccacttgcagtcataagaaacaaatagtcagcggatactcgagttccccttgagatcccctagacttatgtggtgtcagataagatattttctacagactctattacaccacaatagcccttgttcatggcctactcgtacagtagtggcaacgacgccacaatgcacgggaaccatccaatccagggtcatttacttgtaggttagccagctttgtacggtacagtacgagtaaatgtcttcttctctgctccgtgccagatatgtgaatgattgcatgattttatcaattttttaggaaactagagcagctacgaggcggctgaagcgttttgactacatgttaagccaccaaatagctcggttttacgcgtctcgaggcgagcggtacatgtagagagcactttgaagagtcaatctctcttggcttgataagaactggccaataatgagccgcagagagaagccaaggcttatgtttttgccctggtttctgttgtctgggcctgtaagccacatgtcgaacgtctagtacgcatgcttgaaccaagcaaggttcaaagtttttccgagcagttattccgcggttgaaacatacaacaccagtcagatacatggaaacttaagggggataaaattttatccaaatgtcgtgccagactcagggtcttcgggggtctctacgaagccataaccatagcttcattggacttgttgtgtgcctaccaaatagggagagtgccgagtcacctcccaatgcactaatccgtcgtgtacgccaccttgcgagttcccaaactggcttctgccaggtactcaggcgcattagtccgcagttttctaaatgtgatcgaaagtttctgtttcttatgatgccaagctgaatcacctcccaagtaagggcgctgacagttcatgtaattacagtgttgcatgcgaaatctaaatttcggtctagactgggtttgttccagtcctcttaatttctgggccgtatggtcgcattggagatcaagagaaatacggaatcgatacacccgtctatgggctacaattcaacaccaaacaatcgcccgacacgagacccgatacgtctccatagcgctcccgttcagcccctcgctgatcaataggttcttggttttgggagaaaacgaaaaaacttatttgtcacactacttggatttgtcactcaacctcccactgagaggccaggcaagggtcatacacacacaagcaagacaatttgtaaccgtgctctctgatgcaggtgctctggaccaacagcattaccaactgagggtggttagcctgagtcattcgcaagcggcgtacatgtcgacattgatcccggtaattgcctctgtcccgcttctcccgctctatcaatgtgcgacatcatgctatcggagtagagcgagctgttaaccggcgagccgcaggctgcggcgttgacggcttgtggtatctccccctctcacgacactctctcaacagctgacttttgagccaacgcccccacttgatagagttttaatgtacaagcaaaatgagtttattcgtttgggtgcttgtgcacagttttgttcttttactagtgcaacacattgcattgcatctatgagccgtccttgctcggcccttctttattgccgcatatataacgcgttccatagaggagacaagatataagacctgccggaatcctgggatgaaagattttagttccacgtaaacactaccgatttacagctcgactgccaatcccaacctcctctcaaccaaacaacaaccgctacaccgttcctacaagtgctcgctaaaaactattttcagccttgcatcaatcttgatctaacaactacaccatgatcatcacccccaaaacccataacaaatcggctctcaagctaaagctggccgagcccgagcgacactaccgacagggagatattgtcgccggtaccgtggtcatccaccccaccaagcacgagctctcctttgacgccatctccctgcagctcaagggttacatccaaacccgatcggaggacggaacccattgccaccaggcttgcttcctctctatcgacaagaatctcgacgccaacctcactaacctgccctctcagggaaagtccaaggctttccacgccaaccaggtctaccgatatccctttgagttcgagctccctatcgatgtgcccaaggagggtatcaccgctcgatgcgacgcccagtacctcaagctgcccccttctttcgagattgccacttccaacgttgttggcacatacgcctctatccactacgtggtcgaggccgcgattctctctgtcaacgatagggagcagacctcttatttccagggaacgtccggagcctcgtacggtattgccggcgggctgcgatccaaccccggatctctacctggatccgccaacaactctgctcctagctcccccggcactccttccacaatgatgcacacttcgccaatccgaaaggtgtctgtacccattctggtcgtgcccaactaccaccctcacacccaggccaacctgttcaagcctggtcttctgcagcaggctgaagccgccggtgactctgctaaggcccacgctaagttcaaggccggagacgtccagctcatgggaatcacctccatgaacaagatccccatcatcaagacctacaagaccagttcttcttctaccatcactgttcccctgaacatccgatttactcctgaggatcccactggaaccacccccgaggttgtttccatctctgcaaagctccaggcttacactgtcatctctcacgagatcccccagtatctgtggtcttcccagcactacgatcccgcctctggcaagcctgttcctcgacaatctgtggccgagtcttctcgaaacttgttgcatgtttcccagaagatccgacccgcatttgctctcaccgacaaggctgacaagtacactgtcaactttgctctgtgcatccccgacaagatgaagaagtctctggtcccctctttcaactttgcatccatttctcatggttaccgactcaagttctacgtcacctttgcaaacagagtcattgccactgttgcttaccccgtcattgtgtctggatacgccgctgagtccatctctgctttcccctcttccgcttctcttatgtcgctcaacaacgctggtggcaacgacgctgtctctatccctgttgatgtcaacgctcagtctaccaagttcgtcatcggctccggtctgcccgagtacgagcacgatgatccggacagtgctcccatgtctagaaacacttcgggcaccaacctcgcatctctggccacccagaactctgctgcccaaagtggacaccagaacagtgctcaccacattctgaacctgaaccatgagaacagcagaagcacgagttcgctcgttggaaccctgaaacgagcaatgtctgcaacctctcttcacaagaagaaggattaaagaacacccggggcttctgtaagaagctaagaaaagctaacactaatggtccatgtacaatgtttgtaataattaatttaatgatgatgatgaattggattgtacttttagctgcaatgcctgaatgcgatctcagagctaatgaagcgattatgcaactatctttcctctctttcgagttgctttttccgagtgatatttatagattgagacaagctctgaggattggattactgtagaagcagctaatatatacgtgacaggtgtcaagatgctgttagtcgcattctctcattcactgtataaataccttgtcaaaggctatttctatcaagacattcatgacttccgtgcagatgaaggatgatctcgatggaatgttaatttgtgagattttggcgagaaaatacgagcatgggaagcgagggggcggaaagtgtccatcgcgtggacacttcccagcggaactatccaaacgtgttccgatcacgccaccagtcatatatagctccggttagctccaatacattaagttggtgggcaaagctcagcttacgatagagatgctaattaatacaggtacacttgtattgtatgtacgcgtgacgttctttttcgacagtgtttgcatagcctacaagtagatactcgcagggtagcggataatcttgtacttactgtagatgaaacggaccgtgacttcaactgttcgtacaagcagttaagtggcctttatacaggtacatactgtgcccgctaattcacgacagattcttatctgtacagacaatgcccattcgcttgtcttagaatgatcaacggtgtgttggcaggtgccgcctataatcggatatcggtgagacactcgaccgtggcacgctaaaatcttcggttggtggcgacagtcaagctacaacatgtagtacctgtagctattccgtttacagtaacgcgacagtagattgttttccagcctagcgcgctaaacatttatcggaaatacatggtgaaatcaaaacaggcaaaatcggacatgaatagtagcatctttcggtgctatcgatgtctcgtataccgactatcaacgtcaccaacgtcatctcgacactgccacgtctagctaatatagccgttatccatttcttggccgcagtagcaatgataactctaagctgcataccaggaactaaataggtaaaactgtacccctaacccttacaagccgattgttctattctgactggttcgaccaacctgcatggacaatgcagcaatgtcccgcctagccgtgcttgttctcgtcatgtcagatctcatcgcggatgcggtatttaggacggggtactgaagagggataatatgaattgatccactttaatggagatgtcgccaatgcaacacgctatcttccgatgtcgctcttttaaacgattaatctttcgcatgtgccgaagaaagccaaagctaacttttgccaaactcgttcttcagttaccttgttttggtcatcggtatacagccagaccagtccaagttaatcttttcttctacacacaaccacaatgagcaaccaggactactacggagtgagtgaaaacacgcgacagacactgcggaacagctagcagtgcgctatggtcgaacaaaacactaactaaggagaagggcccccaacagcccccccaatcctaccagcagggccctccccaacacggtggaggatacccccagcagcagcagcagccctactacgtccagcagggtcctcagcagggaggaggaggaggagcttgcgccggatgcccctctgcaggaggcttcttcggtaactggtgagttatacagagatggaggtgtcacaattggaacggcaggagctgtcaagaagtttcaggaacacgaggtgtcaagcggagagacatgacaggagctcagaatgaaggtgtctgtgggcgtcgtaggtatctggtctgacccgcatactctacacccgcgtttttgttcgtgtctctgttttctcgtcttgttattgtcgacttttatactaatcccagtttgtccatggtctgtgccatggtttgtgccaacgagattatgggcgccatcggccagtgttaatcacgtgtacacagcatttgtttactcaataataattccttctgtatttttatccccctaatttccgtattccgcacgactttcacatttgccaatagtctttggctatcgtaacttttttggctgcacctgttcatgcaggcctacatgatcgttgacacgccgacgcctgggtccttggtctaacagcagtagttatgacacctggtccgacttcctagctgatagatacatcgactttacgaatttgccggctaacgagattctgcagggcgcttcttggcgctgacacaccttgataatatggttacagttccggctacatggctcaacacggaatctccagggtggagggaccaaaaagcacacacagccttatatggaagtagctgtaagtgtattttatctgatggtggcaaatcgagtttgatcgcctgctgatgatctcataatatgatggaaaaggggtatttgggatcatggctgtaactatgctgtctcagtgacgtcatttattcaatccgtgaaaattgatcacgtgtgaatgtagtttattcctggggttcgggtatacgggcattatgagatacggtggatatcaacttaatcaggttgagactattgtgtagtatattgtatattgaatagcagatatatgatatccgtattagatctgtcccttcgtttacacgagtatgtgccttctatagttctatatctcatgtacagcgcttacttctacagttgtacgagtacatcacagaaagttgcacactgcattatcacggtccatgtttcctagcttcagctcgttcaagcagtccgcgcaagagcagggtgaggaagatgaaaatgatagacgcaagagatcacgccaagacagagacgacaaacccagaaaacgccacgaacgcggcagcgacagacgcagacacaggcacagggagggactcagagactcggaaagacggtctagaagaacagatcacgagcacgacaaaccggcatttacgactgatgtgattaacgagagaattggccatgccagccatttattctttctagacgagactggagatgatgcattgttgaagttctcacagccttatagaaaggaacttccaacatacaggagggcttccaacctagttgtgggagaccacctccggattatccctagcaaggaggattttgagaagtttttagtaacattatgtcgggtgaatccatcagaagtgccaagctccagtcatgattcaggtacagattccgcttactatctcaaataccaccagtgtcctaagaagtcagttccttactacatggtagccgaggaggggtcttccactgtgaccaccgacagcttcatctcaattgaagagaccccatctactaccgatgatatcctcaagggtttgttgcagcagagaatgcagattcaacgagacttgaatatgcaccccaccgtcagtcaatgggagcagatggctgccattcaggaggcgattgcgattctgggctcatccaaactgaagctaagtgaagaccaaaagctacagttgaatatttctgttttcactgtcgccctgaaggggcttcccgaggagccagatattgtgctgaggtacatggatgcattcgaaggtcttctctcactcaataatattgattctgatgtgaacacaaagtggaagtccttcactgcgtacgaccagaacccaccaaaatcactggttgctgacgtgcgtatctgggaaagaagagtagacgcgctactgctggacagacacagcaacttcacaacaatctaccttggattggagaagatcttcgccgacattaaggagtggaagaccaaggatgagtcagttgacatggatactatttaccatgctagtcttcggcgcttgtttgtcatttgggacgatctaggatacacaacgtggactgtgaacctcatacaagccttactagagcacgctttcttcttcaaatatgatgagtctttggaagacttttggagcacacggcagccccgactgggcgattcgcgatccaagggatggaagtactcgcccaaggatccagtttcattacctgagggcaccgatgatcggaccccattcgacgaagtcttattcgaagacatttcgccctttatacaaacttctcaagacaacctacagctgctctgggcgtgtttgttacacatgggacttatcattccgggaaagacccttcctcggtctcttatgtttgaaatctcagaagaccagattgtcaacaacccccaggtcacttctcaggcaattcatctgtgtgagttgattttcagggaagtggaggatgatcccgactataaagcatttactacctggtggggcgattcggactacacggctgactcttcaaacgagcttttcgaggttggtacgagaatcaggagcatggcaagtagaggcttggcctttgaccctagaatatttagcaagctagaacaattccttgatacggagccaggctggcagctgtttctcacttacgggcagctcactgggctcgactgctcttatattctcagagaggctgtttctcgcatcccgatgccattttcttggtggaaggcatacattgagtcagttggaaacgcggagaaacaagagctgatgcatctggcattacacaagttgccatggagtcgggatttgcatgtttggctgaaccagtgtgactgggtgtctcctgaccataaagaagcaatcagaaccgccatgatgagacgacaaatgaacatctcgttgggcgttcttgatgatgatacatcgtagtacagtatatatgttattacaggacctgcacataatttgagtcaacatgcttcatcaatcttttgatgttcatctataatcgttaatttttgagtccatggtgtttcaccacttagtcgctggagcctaccttggctaggtcgtttcgtgaaacaatctctcggagatcagttctctgactctggattaggatggttcggggtccctggatctgcagcagctggttaccggtcccgaaccatttggcccaggtctttcggatcgacttgttggtgttctggacggctcggtggaagtcagagtccaggtagctcttgagcagagagttgttggccagtagtcgctcaatgaagggcaacttgggcagctgcagcaaaggagcagagtgattcagcttgacgaactgtccatgggggttggcgctgccctgggaagtggtgtatgccagcagatttgcggggtggaccaggatgtcctcgtcctcggagagatcaatcttgaagatctgacctcgaccaacgagtgcaacatcacctcgtccggtcaggtaggtgttgccccatcgagtggttccacctcgagcagaaccaaacagagaggtgttgggctggacatggagagcagctccggcccaggcgaacaaagcgtctcgctgggcaacggtccagtcggttcggccgtccagagacacaatggccagagaactctggtaagaggtgttggtagaaaccagaagagtggcaggagcggtggccgagattcggttgtagaggaagggcatgccctggacagttcgagcgaaggcagacagagatgacagacgagaggtgatggtgtcgagctgaccgttgatactgacaatggagcctcgtcgggcaaacagcgtggaggaggcgggcagagacacagacaccagggaagggggagtgccaatgggctggaactgaggcagcagagggaaaggccctcctccagagacggagggaaggtccttcagttgctgcgagacattgtttgcgcgtctaagcgaggtcgagaagctgcgcaattggagacgcattttggatgctgaaagttgtgtggttccgcgtgctgctgtggtgaactaaactctcaccagtgaagttgaagggctcgtacgtcattagtccgggttgctcactcaaactcaatttttttttaccagcatggaaaacagatagtgagtatggcggttgggatggtgtgtggaggagggtgtgaggttattgatgttacgcgatttaaggggtggcgaccattcatttgattcatttgccatgtggtatctttcccgaatgacatgttctgttactcaactacgtacggccttgaccatctacacacccagaacacttcactgaacgccactaaccaagcaaagagcttttgcagtttctagagaacactccagaaaccatggtaacgcccatgccaaacggtggcaccgagttctgggtcgagactaagcctggaaagaaggtgtttcttgacagaggaaagggagaggaggaactgacagttgaggaggccaaggtgtggcttaaacagcagcttcagggaaagtgagaagtgtgttggttccaatggagggagtaaataggccaattaattatttattatgtatttgtcttgtatgagggtgaagatcaccatgttattggaccacaccccagtggaatttctactgtatatagttgtcgatacccactcattacttgagaaacatatactttaatacagtatagattggctaaagggttagtggacacctagacctgcttgacggtgtcaccaactatcatctaagaagacttctggataatctcgttggcaatcttggcaaactcggagctgatgaagacatcgttgtgcttaagacctcgaatgacttcaaagtcaaagggaacaccctgctgcttccatttcttggcaaggagctgaggctggccgtcaaagggaacaagctcatcaatgtcagagtggacaatggtgtagttgatcttggggcaagcctggtgatggagaagggggctctcctcgtcccacttggctttgtcctcaccccaggctgggttggtaaagtaggagtaggtggggtggtcatccacaagagttcgcagatcgtagataccctcggaaaggataatgttagtaggggaagcaaatccgcccttttccttgacgtcggtgtcgagcttgagagagtggaaggcaccggcagagtgaccaatcatggtccagggggcagcaggatacttgtcgaagattgacttgatagcgttgtaaacgtcctcagcaaaggtctttccagagacctcgggggcaagtcggtactcgatagaagcaccccagacgttgccatcgacaacagcctccataagctcatctccatccttctcggtctgcttgtagtcgacccaggcacctccgtgcatgaaaatgacccagtgcgaaggagccttagatcccttagggatccaaacattagagtactgacgagggtcagggccgtaagtgagcttggtgatagtggtcattgttggggttggggttagttgcgagtggttctcagagggcaaatgcgctgtgatggttcttcagtgcgagggagaactgttattcttatacaatcagatcagacgaggagaccaagactaaaatagcgcgatgctaagcggtgagcgctactgaagaggttgtcgtgctgggaagtgtggtgaggtcaagaaacggagctagcgatcaggtgaggcactggttagtttcccgttgagtgccttggtgatacgatgtgatgggtgcatgatgtgggttcacgaagaggttcaaagatgatggctttctgctgcacaagtcaagtactcccaacgagtatactggaactctgtgtgtattctccccggcgtgtcaagtaccaaccttaacatcctccactaaaagtgctctctcgcttcttctcctctcccccacacagcactcacagatgggagacgattgggcccaaaatcgaactaaacaccaaatagatcatgcaatcgcaagtccgattatagcgccgaggacattgccgtctgattatgctaatattgagacacatgatcatctatatgccatatcgagtaaaactataactgccttgaagatggggaatcccctctctgtgcggggcacacaccaattgcattctgagtattcgctcagagttaccccaattaccggttttgcttaaccgagaggttccccaaccgagttttagtggtttaagtgttcttcagcttcttgaggtccagtctatggtgttgtaccaggctgaattgttccgtcttcacgtttgcgagcgggtatgttaacctatccagtgatgagacacaactattagaacaactgagtcagacgtgatttccatcagtatatcttctcatagtatgtactgtacctctggtatccatctgctaacaattatggtatgtacactgtaccgtatgctactgagagctagtgagtaatctctctctctgcgcttgatctagagaattctcgactctgacatagttactcacttaatgcatgaccgtcctatacggtatcttacctgagtagaagtataccagttgtcagtcacagtgtaagtacactataggtagctactacttgtaccaagtatgtaccaaaatgtgtagagctgcaccctgtgcctgtaacagttacaaccgaggagcttcaatccttgaactaatctctaagcttcaagctagaccaacttcaaattacagaaatggcaaccacttctaatatccaccatgccatctcgttcccactctacaactactcccgctcatatcattcaccatgcaaactgtattaacagaactatttttacaaccgtagcggccgtctcccctttttgtggcatcctccatccactctagtttctcttcttggagtagtcgaccttcataatcaggttgtcgaaaccatgaccatccatggcctcgagagcagcctgagcgtgtgacttgagtgtgtaggtaacaaaggcaaagcctcggggtcggccggtatctcggtccttggcaacgtagactcggttgatcataccgtacttgccgaacattcgtcgcagatcgtcgtctgtggcctcctccgacaggttggtaactcggagagtgagctcgtcgtcgtcgtcgcttcggccaccagcagcaccgccaggaccaccaggaccaccaggacccttgtttcgaagatgagggggaacgtagcctccagtcttcgcagcgccagcaggctcgtctccaccaagagatcgacccatgcctccggcagctgtggatccaccaagagtctccttgtaaggacacttcgaggtgaaatgggggccctgacaaagtcgacacttgactcccttgtcctctccgacacgaggggcggcagcagctgcctcctcctcctcaacctcctcctcgggctgatcagacttaaggccaagcacaaagacgatatcttctccaatggtggtggtcattcggttgggaccaggaggagctccaagctccttgccgtacttggtccatttggatcgctcagcaacacagttgagcaccttctctgtcacgctctggttcttgatggtgacggaccgcttgtacttcttgccatcatccattcgatgagtcacgatggtcttggtgccatcggcgttctgtgtgatctggggagtagaaaactcgtcgtcgtcggcccacttttcgtccattgtgttctgtcgaaagtcttctgaacctgtgtcttgatgatggaaggtctgcatatttttcaccaactaagttaccctggctttagagttgtgagaagggctaacagtacataagggatatattgggtaagtagtgggtattatggatggcagagactattttgacactcgcatatggggtttaacaacaacccttcttttgttatatgaaaattcatctcaacagtggttttgggctaattttgcacccatctgagatctagcttcacgtgattcgaacttctcccagcctgcaatgtacgagttttgtagcaatggttgtgtgttcgattccaggtagcgtcatatgcaaatgtaacactgtccagctatatacagcaactgtggggaaaataaatgtcttggatacttgtaccggtacttgtgatgccgtaaattatctacaggattatggcatatttctcccggcccctcgacgagatctatatgtaaagtacagttctcgtagttgtaagacgagattggtgatctgaagagtaaactgcgatcaccccgttgtacagtatgtacaagcacagccaggacaccacgtgtaggttactgtagctacattacaggaagtacgtacctacagtttgtccagcagaagaatgtctcttgtgtcatgtgaagcaaaacgtcggaagtgaagcagttctagaactattgctgcctcgattttgggtctacagtaattggcgtaaattcaaaagtgaggtaggtactggattataccgcccttataaatcgtctcaagtcagatttatgaagtctactgctccgatatcgtcagttgaccctccgatccacacgcatacctgcacatggactgttcttgtgtgtccaagtagccttttgatggatacgagcagcaaggttggcaatcgattgtgagtctagaggagataagaatccaaagtttgttaagcgaagcaaggtaaccacgtacgcaatgatcagggtgtgagtgggaggagtggctactatattacctcctaggccctggcggggacggttttctactaagaatcagggacgggttcaacggctgggctgtctcagagcaaggtctctgttgcctcccccggtgatcatcatcagccttggggagagggagtcgcgtgcagaggaacaatgggctgacttgccacgtgcacgagaggctccgacgtaacatacggcacagtacaagaaccgataatatctaccccgctgctgccttctcctcaccgcggatttaattgctgatacggcaatatactcgtactggaggctgcatggtccactttttgtctcttacggtgggtacatcattttcttagagaaccatcggcactaaatgggaagtctaagcttcggacagcgagagggtgaccatggagggctagcaaagagtgataaatagtgctgaagatgttactttcctgtacatttcgataatgaaccaacagactgtttatacttagaacgacacatgatctgagaacaaaaaaccgcactgtgacggctggaactgcggatgtgttttaggtctcaaagttggaattccatctggacgcgccgcacaaaaccaagcgccttttagctcttgagctgagctagtctggcataaactgtttagctgcgccccgctggaacagctatacaagacttgcgagacccataggtctggacaatggcagctatacgagaatatgtggggtcgcttctgaacaacgccacgggcggcagcgctaacaactccaactccggcatcaacagcgcgcctgacagcgcaggcacttctccgaaaaaacattccttggcgttgccccatactccgccaacaggcacttcaagagccgcctctcactcgtcggcattcaattccgcctccgacgaggccgacgacaacgtgcagtttcgtgacattcacccggccgctctggtgcggaccgaaaccgaggatgtggaccgccagctcaaccacttccactttgaagacaggggcgccagcagtgagcccgagcagattccgcttcgaggacggcaaggccgcaaggatgacccttatggctcgaccttcttttctgccaaggagacctttctggatggacgagacagagacatcaagctggtgatcccagagacccgagacagcagagagctgagtcgtcctagacgatcaccggtcagtgcaacggccagcagccacagcggaggaggcttcttctcgagaattctgcagaaaagaaagaactcaggccgccaaagtatcgaggcagaagagcaggaggatgatgaacaggaccaggatggggaggacaaacgagctgagggatggtgtgccgatgtcatgggatacgcgccgaactactcaatgttttctgatctcaagtacgtcaaggttcgagctcatcatcggcctagccaccagaagaaacgaaacttcgatcggttatttctggcccaggagctgcgaacccacgacccttcggaccctctggccaccgacaattcgcgtctggcaagccagactgcccaaaaggtaatttccagcagtcccattggcgccatttgggccatgaaattctctcttgatggcagatatctggctgctgctggccaagatcgtgtcctgcgggtgtggaaggtctgcactcgacctcaaaactctccttacgaagactactttggattcaagggcaccaaaatgtacgcccctgtgtttgaagagagccctgaacgcgaattccggggtcatgaaggagacattttggatctgtcatggtccaagaacaacttcctcatctcttcatctatggacaagactgtgagattgtggcaccctgaccgtcaggaggagatcgctagtttccctcacaatgattttgtcacttgcgtggaattccatcccaaggacgaccgattcttcgtttctggttccatggaccgacagctgcgactgtggtctatcctggacaatcaggttgccttcgctagacaggttcccgacattgtcaccgccgtggcgttcacccccaacggcaatactgtcattgcaggatgtttgcgaggtcagttgtacttttaccagacccaccagcttgttctgcagacccaattgcaggtacgaatctcaaccaaggtcaagcatgcatacaagagcaaaattaccggcatccaggtggtgacggagcccaaaaagtcgcgcactcacaacaatatttataaccccatgcacgctgccgtggcagctgaggacgattacaagatgctcattacaaccaatgactcgcgcatccggttgtacaactaccgaaccaaggctctgattgccaagtaccgaggtctggacaatgatcattctcagatcaaagcctcattttcggacgactacagattcatcatttctggatctgagggagaaagaacctacatctgggacaccatcagatccgatagtggtacaggtcttaaccacgtgtcttcaaaaacaatcaaagcctacgagtactttcactcacatcagagcacagtcaccgtggcactgtttgctcctctgcagactcgacagctgctggatctggctcatgatcctatctattccatcgtcaaccctccaaaggtagttttgggacagaacgacatgactcccgaaaaggctctgtatcctcaccacgacggtcatatcatcgtggctgctgactattcgggtaagatcaaggtgttcagacaggactctgcctacaccaagcgaaagctcgccgaggactctgcatcttttatccagtcgcgacgttcgctaaacagcattggaggtgcctctggcaggtcatctcctcgaggcagatcttcacgatcttcttctgcatccgcctggaaccgattctctcgaggagtgagatctcccgctgtctcacctggtacatcggttcatagaaagagttttggcgcctctaccagcactgggccggctcctttcggtgtgattgctaacggtctttccagcgccaaccacaccatcatggatccttccacgttcccaagggcacgcaagtcttccacttctggtctttcccagatttcgagacgtacttcggagtctctgttctctcccgaaaagtcagttcctgaaattcatgtcaatgatgaggacggtcgtgagatcgagcctactggtagcatcagatccaactcagttctcatgacggactccgaccaggagctggacgaggacacggaccaggaggagcaagatgagctcactgagcaggcttctctggtatgcgagaagtgtggctcgcagaacttcaaagtgagagtcattgaaggcatggtgattctctgctgctcggcttgccgaacacccatcagtgaagcagcatctacataacatttcacccagactctttgaatataaattcaccacttgttgcaactgtaacctttatcttaacactgcgtgtagcgtgacgatttaacgtgcttgtgtagcataaccatctaaatatagaccatggaaggagtgtatgtacatactgtatatatacatatcgataccaatacagctgtgcactgtagacatccagtacatacgagtacggtaattgaaagcgtttccacggatcagtgtatctacagagtgggtctctgttttccggtatacatgatttgtttccatcgcaagcttagattgtgttattattgtagctacgccataaaaatctgctcgtatcagtagagaaagctacccctattgggaagttggggggtacttgtagttgccctggtgtacttgtagagtcatccactggccgaaagtggaaccggtacaggtacagtatgtagtgtaggtgtatcttcctcgcaatacaaatgaagcctcacgcactcaacgattagtatttgcatcatacgattcaatgaatgaagcatatacacaataccaatcatatcaatctccatcaatcagcgttgcctctggtggtggttataacattcagcctatcccagggcttgattttaaatgctcgtttgatggtatggtatggttcaactttagtgcacgtttagtatgccttcgtaccattggaaaacgtcttggtataaggacactgtgtgcagcggcctgggcaggtgtcagagagtacatgaagcactatactttagctacaagttgtaggtggaacccttcgggttatttccgtaaccacgaagatgtcgttatcggtgtccgttgctcgtcgcgtcaattctggtgctgaacacgaacaaattgcacaatcgcttgtagatcagtttcagctgcatgtacggcgttgcttggtcaaactgtgtgcactctggcatgaacctttctttatggctggagatgccgttgtcgaccgtttcggactcggtcattagtttgtctcaataaaatattattcgccttgtatttaggttgtgcgccagtgccatagatcaccacgaaaagaaactggacttgcctttcatagatgtatagtaattgcaataacacgcttcgacagcaatagagaaaacctgaataccaatttcgcaatctcaacctcccacgaacaaaagagacaaatgacccccaagctcttggcaggcacatcggtgcagctacccgcaaaatctcgcaaaagaaaccagacagcgacaaaccaaatccatgaaaaagttcataaattggctgtgatggcccacccaatactttgggactgagtttgtgacgtgcagctacagcgcaccaagcagagcaacgggacctctgtctgggagttatatagatagatcgctttggcttgcggttggcactctctgaaaagtttggtccccgtcgattcgcttacaatattctccagtttaggtcctttctgtacaccaaactgaaaaataaggaactagttacctaaccaggttcagaaccaacaacagcgcacactcgacgcatcatattgcctgaatcaccaccaatggtcttcaagtacatcggagacactttgggtcttaccccggtgctcaagtcatcctgggacgtccatgctctcattatcatgcgatttttccgactcatggcgtttggccagatctctgtcattctcgcccagttttttgatgcccatggcttctctcaggacaagaccggtcttttcatgtccctgactctcgccggagacgttggcctgtccctgttccttaccacatatggtgaccgactcggccgaaagaatgtgctccttattggagccggcctcatgaccctctcgggcctcgtcttcttccacgagtccaactactatctccttcttctggccgccatttgcggtgtcatttctccctctggtgctgaggttggacccttccgagcaattgaagagtccaccttagcccagctcacaaccctggaggcccgagctgacgtctttgcttggtacactcttttgggatctctcggagctgccctcggagcccttgtcggtggctggaccgtccagattgcccaggagaagtaccacttcaccaagcttgaggcttacaagaccgttttcctgacttatgcagccattggcttcatcaagttcattgcttcctgtttcctttctcgaaaggtcgaagctccagctgaagagaccgagcctcttcttgccaacgatcaggagaacgccaccgaggagcgagctgagctccgaaacaacatcaagaagcgaggtggtctgcgaaacctgcttcccaacatctcccccgagtcccagaagatcattactactctgtgtcttctgtttgccatcgactcaatgggttcttcccttgcgaacttctcctggatctcctactacattcaacgaaagtttgacatttctaccggataccttggttccgtcttcttcgtcacaggtatcgtgggtgctctggccacccttgttggatctggtatctctcgacgtctcggtcctcttctgaccatggtcgtcacccaccttccttcctctgctttgatcattcttctgcccgttccttctaccgtgcaaggtgtcatcaccattctcgctatccgagcctgcactgcccagatggatgttgctcctcgacaagccttcctgtccgccgtggtactcaagaacgagcgaactctggtcatgggatgggttggaactatcaagactcttgcccagctgcctggaccttacatcaccggttaccttgctcgacacaacaagcagtggattgcttttgttgctgccggttctctcaaggtcatctacgatttgtctatcctctcttacttcacccgggtgaagcttgatcgagatcagaactaagcgtctcacaactcacactaaacatacacaaaaagacaagaatgtgtcacctgtataagtcacatgtcaacatataaattatataactgaatatacgaatgaatatgcagttgcagctgtaatggtcatgcttttatctctcctctcctccaagttaccataatatatttgaataaataattagcgttcatgcatctcatgcagttgtggatgcgagacgtggttttgtcatctttcacacgccatgaacattatatcaaacgccctattttcgacaagaaacagatgcggctactgcaaggatagagagggtgcagagccgcaagggacactgttctctttcaactccgttcagatgacagccgcacaataccaagcactcatagatcggggcttcagacgatctggcacatacatttacaagccagacctggctaactcatgctgctctcagtacacgatacggctcaatgtggaggatttcaaagccagtaagagccaacggggtgtgcttaacaggtggaccaaccatgttactgataagggaaatggaggaaagaactcgggcaagaacaaccaattcgatctggtagcaaagatccaagagggagagaccgacgcattcaattcgaggctcgagcccaacagtttcaccaaagaaaagtacgatctgtacgcaaggtaccagaagcatgttcacaatgagggccctgaagatattagcgagtctggatttcgtcgattcctgtgctctgacagtttcactgattccacaagtgatgtctgtaaaggtctagatgtgccagatagactatctggaggctaccatcaactatattaccacaatggtaagcttgtggctatggcagttttggacattctgcccttgtgtgtgtcttctgtttacttcctctgggaccccgattatgctcagtgggggctgggaaaggtggctgctatgagggagattgctctggctaaggcactgggtgtgccttactactacatggggtactatattcccgactgtgtcaagatgaagtacaagggagagtaccatcccagttttgtgttggatcctgaatcgttgactatttcagaacaggaaatcgacgattatcccttcccagagggcattaatgtggagtcgcgtgcattggctggagttggtgtttgggtccctcttaaagagatgagtaaaaatatcagtactatggacgactcggcacggtattactcatacgtccgccgcagtgcaaagacggtcgacagacccaaggaggttgctgcgagggtgcgatatgaggatttgagtggtgcaggctacttgaagctcgaggaaatgatgaaaggccttcccaaatttgctaacaagaaacagtttgtggctcctcagaacgtcttggacgtcattccgttcgagggacagaagatcgagtatttcaagtacgacgatgacatgtacagtgatagtgaagatgaggaggaggtagaagtagaagaatgggataagaaggaaaacgagaagcaaactgtggagggtgttttagtctccctggcatctctggttgataaaactaactctgcatttgctaatgaaatggctatgggtctgctggccgttcgagccactgcaggttctggtcttggagacaaaactgccattctgatgggttagactgaaacagttatatcctttaacaaatcaaatgaagcaaatattttgtatacaagtagctcatctcatgcccgataaactgataccacccgtccgtatgcgtgatgatgcaatgtgcattccaccacgccccttgcgctgcaactctaactgattcgggagctctggaaccactggaccttagtccctcactttcgttgttcgaacgtcattgaaacaaccgacaggaaccacatacacgaccgacagagacttgcccattgctgaaggttctcttgtccctattctcaccagtggttttttaaaaatctcgccaccccgaatgtaatggcagcattggatattttgatgctggcgttcagcatttggtacacaggatgctgtatgtaccaactgaacgtccttcagcgacagtacatttcgtttacaatgtatcacgatagacctccattacttctgtcattccccttttggttggtgattgctttgcccaagtacactttggataccctggaaagagtgcagcggacatggttcaaccacttcctggcttccgtggtggggattcagtatctcatgggtttacttgcctcggctttgtgggtcagacgaatccgagagttgcgatacatgattgataacggcacctactatgaccacttcccggacccaggtgaacatgctgactatgaaggtgaagacgatttcgagctcgatgttctggacgagacggtacccgccatgaatggggctgttctcgttctcgccttccatgtcatgctgggcatagtcatggtggtcatcctgatatcacaattcattgccaacctcggaaccatcaaagtgacataaaaaagacgactatgtgagtttccttcgccactaagacatgcccctccatggctttgcatcatgcctgacacttgaagtgcaggctccgctatgcagagagagcagtcttggctgttacagacttactttcatgagaacgagactatccgtgatacaatgagatattgacgtgctacgagacagatgatctaatagaagaataaaatacttattaaataatgattggaacatactgagtgtacgttttttgcgcttaaaggagagcggccatgacggcggcaccgacaacaacggcaccgacggtgttaagggcacccatgttggccttctcggcagtagcggagccggcagtggtggggacggcctcagacgcagaagcaacggtggcagaggcctcagaagcagagccggaggctgaggtgatggtcacattgctgacggccttggtagtagaggcaacagaagaagacgggccaacggtagtgttgacgaaggacttcgtagagttgaccacaacgggggtagaagaaaccgcggggacggtggagttggcaacaccggtagcggtagcgttgccaaagccggtatggttcttaccgagaagaccgaaagtgggctcagcaataagagagcactcaccagtgcaagaggtgatagtctcgtagacagttcgcttgggcttggaagaggattgagcagcagccagagtgaggaaagcaacggaggcgatagagaactgcattttgtctttggttagcgagtgtggtgaacgaacgagtgtgatgatgaagaagaggaggttaggaggaaagggcctacagttgtatataggtactatcgcggtaacgcgacgcaaggaacaaagacgttagtgtcctactgcaagtagctgttttcaattggcttgggtacagttgagacaaaggactatcatgcaggacgccacaaggagaccaggtgtattttgttttacgttgggtggagattgtccttggacgctgggtaagctctttaggctgttgagagtattgaaaacacctctctggggggactaaaatacccatatgatgtccggtttgccttgacagacaacccagaatatgttttccatgcctagaccgacttctcgctactggacttggcagatgttagagttacaaaggtagcagggctgaaaggcacaatgggggagtgtacagaaggaatgtacgacaaccttcgaggagattaggtgacagaaaggagagaagatcgcccaaaggagacacgacgcggtcgtgcgaagagctacaggacattggaatgtgataccgagctcgcccacgtgcttttttgttctggtgtggtctgtgagcccattttaggacctgccatctgcttggtttcacgcctctgcatctacttttagctacaagatgggtttcacccaatacgaaaaaaacttgagtttgacttcctgtcgaaaaaccagagcacaaggaactacagtaaattgaacggccaggggatcttttggaggttgaccctcggcaactttcagaaccggccgctgcggttactttttattttgagtgcagcgcgacacctgtattatgagtcgtacgcgcaatgagaacgagctgaagatctggttgcttctgtaaatgtggccaagaatgtgccaagcatgcgcctgttcaaataggcatgccttctgggaacgtagttatatccaagaactgatgacccatatttcactcactgtgatactatggaacaaatatcagccgtgtggcgcgctttaatactcctatgatagaataaatcaaccttgtccatcattgtgcctctacactgggtgtattccatcctgacccggctgtctgtctcacatgattcatacggagttgcaggcagaactcataactacttgtggcggctaaggaaatgagaatgagtgtctgtgtctttttacaagatgatggccggctggtcgtgcagccgtgagcagtgcttccaaacagtaatgacctacagtatgtacatctgtgcaaacagacctctacagtagcgccacactaatgcctggaaaacaaaacaatgcccgtaacggcatgaaattctgtgtgaattcttcctcttcagcctcattcgccaatattatattggccaaagttaagcccgatttacaagcatctgacggctggattctctacctattagttcgtatgaagttgtgcttacacacagtgtaagacctgaaacccatcaataatgagtagactagcgtgaagattgtagcagtttctattgtatagcggcggcttttctgactataataggtacctacctacagtaattctcgtactgtagcacgacgagccagcttgtgcggagttactaacagctttcattggctataggataggttggagtaattgaccttgaagaaacagcctacgtgttttaaccaagtcatcaagaacgaccttcatccatacaattgtatctgataacgtaacagtcacatcttcgggtcatcttctcgtatcgtcgtacccaaataagggtctacatcctctattcttgcgtatactttccgtatttttcattataatgccaaaagaggcctctatcgacccctagattgccaattgtgtcatatccatcttactctgtcttcttcgtcttcgaacacagagacttggttagctccaacgcgatgccaccaagagtgccgacaaaatagcccaggtaggcaccagccaaaattgtgatgggccactgctgccagggtcggtcccagtcgtaaggaatgggaatagctcccagccaggcgccgatgagggtacacacggacgctgcatagacgtggtccagaggacgtcgcatagcgatgatgtctgcccacaccttggagtcgaggtgatatgtgaagaagagaggtagcaccgccagaattgacatgtgcatggcacagacgaacgtgttgtggaccaaggagatagcaggagctccaaacaacacgagaaggccgaagatgattaccgagaagaacactgacaacgcagcagcaatcatagcagtagacacatcggttccgatctttcggccaggcttgttacccaacacaacaacgcagtagcccatatgtaacagcagcagaccgggaagtgcctgtgtcatgaccttagcagggtcatgtgtgatgccagcggagaagatgaaccgcaggtacaccagcaaaagcgtaccgtagacaactgctagaacctgagaaggtccactgggaacgtgagccgggccattggccttggtcttggcagctttccgagtagccatgtcgaagatggtttctggttaagaagttttgatttggtgacgaaggttatgcaggttgcgtacatatgcactcatcgaactgtatggcggggggtggcatcgacacctgatgacgtaacaaggcgcgtttttcgatacgaaagcgaagcgtggatttctttctaacgcggttggctcctttcgtgaatcaatcttagtctgcttctattaacaacgggatatagaaatacccagtacattggaatttccagccaacttggtagttagcttatcgcagattttcaatcagcttgatcatatacagtatacgtattggatagctttgacggggaatagggataaggtctgtttgtatggaatgcgtttttcacagtatgtactatacagtagcctcctatctgtttgccttacgttctaatgttctctttcccgggggtacccagcgaagtatagatctggagggcgatgctctgttccaccagatcggcaactcggcagtgtaaagccacgttggggaagtactgtagcatgttctacgttgttgggtatgcttatgaccaacagtctacatacggtccatggtgcccgctggtatatctctacaactgaaaagagtggggtgttctgttctcacttaggatggtgctatttgtcgacagctgcttagcctggcaactggtatgtactgtagctacaatactgtaactacaacttatctaaaaatacactaatattaaaatatacattattgtgtcattgacagactcaaatacatttcttgaacaggtcagagatgagctcaaggtccttccagatcaactgctgatatcgctgacccagacggttagcatacacgttctgcttgtttcggggcaggttagcaaatcgaatcaaggtgtggccatcaagaataggtctgtggggactgtttccagtgccaggcaagatgggatcgtacctgtaggctctaggatgtaacccacagacgtgggcttccttgtcggtgatctgagtctggatggcatagagacgtctgtaggcatcttcagggcaagggacgacgtcagtcactgatccatcactgcacacaccaatcaccatgaatcgatcctcgtttatgggtaccatggccgaggaatcgatcacctttccagagtagaatacagaacgtctcaggagacgggctccagagtacgactgagggtcatcggggtcgtactcgaggatgtgcagtcgtttctggagatcagccacaacaaatgtcaggttctcaccctcgatagcaaagtcacaggtggtaaccaacaccctctgcaggtcacgggcgaacgggatcatctggtacgggtccatggagaacccgacaaactggacagatcgggtggcatcaccgagcagaagcatggagttcagactcttggcaacggccacgtaagtctgcatatcgaggaaagcaacaggaacgagggtaaggtcatcctgaagagcctgtacaagcagcttctggccctggacagctagaagacgaccagatacctcgcagacagcagtgaaggccccacggacacggtcctgaaccagcttcttgagtcgtctattggtctcgggtcgttccttctcaggaacaatctcaatgacatcaaagaggtacagagcacctcgagcagcgagatcctcacctctaagaatggaggttccgacagccaccacctcccgcttttgtgactttctatcagagatggacaacttgacagactcgcaacagagggccgcttcagcgggcatctcgaactcataggagtcaatgacagtccacgaataagggttgacgatgcgaatggcaccctgataggtagtggcaggcatgatgtctggtgtaagactctcgatcacctcgtcgtcttcatcacggacaacatggggaactgtcttgtgagtagcaatgacataaacgtccatggtctcgtgatatgtgactttggaaatggtctctccgcagagctggacatgcttcacgggccaattggtctcgagagaaaagctagggtcgaatctgcactcggccacctctcccgcttgcgtcaagtaagcaaattttccgtcccaggaagtgaaagcaactgcgcccttagtctcaccgaactcgattagtcgcggagaagtatgcaaagtcttgactaagatgtacgcggtttcaccagtcactccaagtgtgtgttttccgttaataagagggacttgggtaagtcgtctatcggagttgattgtaggggttcgctcaaggaagatctttcggaacctcagcttgtcattgtagtgataaggctcataaacgacaagctgctgaggagtgaggagaaccaggtagtcccgaagaatatgatcgtctccaaggggactcaatgcgatgtccacaagttcaagaggggcatcatagagctgaccgtccttctctttgatgaagccagacagatcagaagcatctagaatgagacgatcgtcggaattcagaccttggagcagaagagacccatccgcgtagcacacaacaacaacaggtcgcgagtcttgagcgggagatccctggcgtgtacgtttcttgcttggtgcaccgaaagtaagggaggagtcagtggcgtagataccgatggccttggactcactggcaggctcgatagagacctgcgcagccttcaagaatggtctcttgttgatgctcacggcctccaatatcttcacctggccatcagacagcaacacaagcacgtagttgcccagtacacgagcctccacggctgtagtaccttggggcagggagtatttgtggggctgtccgatcttggcgtcgtaaatgttgacagtttccaaacagacctggaggagcgccgaatccagcattgaagaagaaaagattgtggtgacattcgaaacaaaatgcttcttggtcttcttcttcttggtactgagagaaacgtcttcaataaccccagcggcatcaacatagtacagatatgagttctcactgtcagacgagacaacataagttcgagatttggcaacctccccttcctcctcaaaacgcacgggtactgaccagaactggcctcccggcatgtccttatacaaggacttgcgtttgtatggcatcagtgcgcttgtgagaatggccagagcagagtttgcaccgacacctgtagtagtgacaaactcaacaccttgactgcctctattcttgcccaaagccagcgattgcatgggtcccataccaagcatgcggtcggccagacgtagcttcaatggacgattggtagtgtcctctgtttgagctgtgtcaccgccataaagatcatcgtcagactcgtttccgtcatctagagtctcctcgggctgactttctggctcaccatggtaccacttgactaagagcgaatctccagctcgagatccaaggaaaatagttccatcaggcccagctgcaacagaggaaggctgggataggatgaagttgtctggctcaataggtcgcagttcgagactagccacacgtctaccatccttgttgaacagcagactgaaaaactggccatcttctgtcaccaagagggcggtattgcccaactcctggatgaagcagacctcagcaccttccagtcgcaggtcaagagtcgactggtccctcgatacgatgagatcagagttttgtcgatgtgtgttgttgaccatgacacctgtgtaactagccgaggagtcgatgtagagaatggtgttggcgcagatgataagtgagccaccaagaggagcaggcagaggaatgaccttctgggcatccactggcaggccattcaaggtaccaattacggtggagttcttctgatggacgtcgacactgacgatagcgtagctcaccgtgtccttgagaatattcttcatacccacccatgctctcttgggctgaaaaaggatacccattgtcgtttctcggtactcgtgaaggaagcagatatccatcacgttctcgatacgtttatcgagcctcgatgccttaacaatgaaggagggatcaaatacctggccactttctggcatctcatcgtcatcaagacccttctcgataataggcagaaacgccattcgatcattctggaacagcagacaggtgtagaacgagttcgcctcatctgatacagcaacagacgagcactcgggctcgaagaagttgctctcgaccaagcctttttcgtagtaatgcagcgatttggtgtcgatggtgaaactgctagcattccatgcaacaatcacggccttggcatgcttgacagagatgtagagcgaatccaaatcgtagttgtcgattgtctttattcgggtcacgcccgtgacggttccatcgaggtagtattcggtgatgagctcgagtcgaggagcttcatccttggtagggatgtcgtccttgtatcggaagatctggagcagctgcgagcccttgactagcaccaggttcctctcgccggtgaagttgcacgacagactgtgagtgacggcggtcggctctgtcagattcttgaaaatgtgcatgtcgtgctactgtgagacagtatatcctgtagttccagatcgtgatgatttcttggactttcagaaccttaagtttgggagttcggacgggatggttgaaagaggtgtgacgaatattgaggggatgtgtgatgtaagggcaatagttttgaaacgaaaaggcatttaagagaacttctggatattgagtcgtgactggatgagccctgtgtccagatgttccttacgaatcgcacagtgttacttacattagttgaaatatggagcgggtgggtcgggcagtattacggctaccgaggtggagtgggcctatttgacagaacagtatttactaaagtcacttgttttagtgcaagctaccaagccgggtatccatctctactgtggcccagcatcacacctatcgcctcttaattacaagcactttccaacatgcataacgaggtaaatacttgcaagttcaacatcaaccgccacactttgctagatcatgcaactcccacccgaactgattacactagtggcgacttttctcgacttcaaggacctgtctcgattaacatgtgtcaacaaacacctctatgaactgctggcaactgacatctggaaagacgtctactactctgcaggctacgttccccctctactaacatgtgcgcccctgatccagcatgttcatttcgactcagcagtcacaacgatgttcttcaaccgaaaaaacttcccagcaatcaaacaattttctgtatcgtactacgaggatataactccgtggatagggttgcctgtgggcactgtgtttcgcaactggaggcgggatctgtatcagcagttctacccccagctagccgagtatctcaaggcccacgaagttactcttgccagccttttgctctacgaccagtcctttctctactacttcattgaggcagacagttgtcacaaaatcgagaggttacgattcgacaccaacttcaccgacacagttctgtaccatgacaaggtgtaccctccgatattgcgactagcaattgttgagaagttcattcgcgctgtagaagctgcagggtgcagacctccctttgatcgtgatcaaggcagcttgtcattttggaaccagattgaggacattgagagaggtcctgatggtcccatcatgccaccgcttccagctgattttggagacttgtctggtgaacggacttaatcgagatctactgaccaatcgaatcgttgtcgtgcattgtcattatataaagatggtgaagatttactcgtctttcacgacaggcttgggaatgggctttcgaaggacatttccgacctcgttgagcacatagctggccaggaaaagaacagggatgtgcagaggatttccagcagcccatgtaaacttggtgcctccaaggttgagctgaccatagaccactgccaggaaggctactcgcagaacggtccagggaagtcgaccaatgtaagacgagttggcgggggacccgggagtgaactgacactggtactggttgccaattgagatgaacagagatgcaactgtggcagcaagccaagtcttgttagaagtaggcacccgggtacacatgagatacgaggcgtaagcagaggccaaagtgcccaggccgccgacaatggagaactggacaccctcgtcaccctggacgttgagggtagtttcgttgaggtgattgaggatgaaggacatggtgtgctaatcgatagaagatgagatgagcacagttggagatgatgtttgaagtcctttagagttgtatcgtagtccaatttctgcatgtgaatatgcaccccacagagacgtttgagtgcgagtgctgtaacgattgggaccttttgagtatggagctttacttcattggggcgatgagaaagtcgcctgtatgtctccctgttatatttgagcttccgtgtgttttttcaagtaaaataatcgtcgctatcattagctacaagcatctctttcggatgcttgtaataggcgttatagacgtcggggttttgaaggcaagaatctcagttgccttatagctggtcattcagctcagccatagccagtttagttagagggagaacccaacagctacattactgttcgcacttgtctctatgacccctgatacatcatctaaaagagccatgtgcttgaacatcctttcttgtatggatttactcgcaaggcccccacgatgtatgtaccgttcgtaaattgtgaataatatttgactcactcaacctctcgatgtgcctgcgtgtacagtaagtacaagtacggtaactccttcggtcctcccaacgcgttgtctgtgaggcttagatcgaaatgtctacttaatcatgtaccaatggagagtcgaacgcagttgctcttccacaggctgcacactctcgatggtcgcgatccagggtttcggaataaatagagttatgcatttctcggtgtttttttcggttactggacacactatatgtcgcttcaagtgtggggaaacgacggcatttttgcgacttcaggaattcaaacactcagagctacaggaagaggtaggaaagctgcatgcgtggggataaagaaaagaactacttccggagttgattctctactacataatttacagactgataataattaactcatttgtgtgtcacaggaggccttttccataagaaagcttgcatgtcacttgacagggctgaaagtgccagacagtgtacagtacatcctgtacgtacatacattttacaagtagaactaacaacggtcttccggctatacaagggaaaaaaaggaacaatgagccatgtcaaagaaatggggaaaaaacaagcggtggattaaaggttctaaatggaaaattataggctccatcagacaaccggaactaataacaaccattaccaatacgacccccgatatcgcatacctctggcaagcggcatcggcccccttactatgccgtaccgctatctccggttgccgacatcgcctatcataacgctgcaaccatagttagagcctaagagtcacccccagacaaagtaaagcttgggtggtgaaaaatgatgcaagttggcacggacctaaattatcgaaacccgaagcgcttcttagcatcttattcactcgcacccatcttcccgacgcatcacccaaggacttgacacgtctagttcacctcttctaacgacacagacccttctttccgttaactccggttccgctcaccagatcaggaaagcaagtccgaagtaataaaacctcgacgacttccactttcacgctacacactacacacacaccatggccgttattctggataagcaaaagaaacagccacccaagcaaatctccactctcggcggatttgtggcgggtgctatcgctgcctgtggagccgtcacagtcactaacccgatcgagttggtgaagacccgaatgcagctgcagggagagctggctgctcgaggagaggccaagaaggtctacacaagccccctacaggctctggtgaagatctacaagtccgagggaatcaagggtctccagtccggactcttcagtgcatacgtctatcagatcggtctcaatggttgccgactgggcttgtatgagcccaccagaaaggtgattgccaacgtttgcaacattgatctgaacaaagagaaccccgttggtctcaacgtggcctctggtgccatctctggtatcatgggagccgtggccggatcccccttctacctgatcaagactcgacagcagtcttactctcctgcattcaaggtcggagcgcagacctactacaagtccatcggcgacggattccgacagatctacggagcagagggcttcaagggtctgtaccgaggagttgacgctgctattctgagaactggtgctggatcttctgtccagctccccatctataactgggccaaggagcttctgctcaagcaccacatcaccgatcccggagcctccacccatctggttgcatctgccatgtctggtctcggagttgctgtcgtcatgaacccctgggacgttctcatgacccgaatgtacaaccagaaaggcaacatgtacaagaatccctttgactgtctgatgaagaccgtgtccatcgagggaccgtttgctctgtataagggtttcggggcccatctactgcgaattgcaccccacaccattttgaccctcatgttcatggaacagaccatgaagtgggtcaagtggtttgagggcgttcccttttaaatagactacaactatgtatagtagaatagacaattagaatatacttaccatacgacgaggtatggaagggggcttatgacgctgttgttgcacagcatctctaggagaacctgttatcttacattcatgcactgatatgaaggcatgcatattaaagactatccaatgtcagaacaatcattatatacactacaagtagacactactgcactgaacatgttatcatcacttcttccaaccataagtagcactcagtctagactggagatgctcctctgcggtgatgacctttccttcgttagctcctcggccagttacagaggcaatctttgcactggggacaggttcaagtcttacttcttcctcgggatgacagaagaagacacacgaatatcggtccgttccctcggcctgaagcttggctggaaacttgactctgtgaattgtgctcttgagaataccagctgtccagtagctgagcagatctccaatgttgacaaccacaggtggggccataccaggctccttgggtccaacgtatgggacaggctcccacttcttagatacgggggacaaaatctcgagtccttcctctccctctcgttggaaaagcagagtcaaagatccgtagtctgtgtgtgctcctgcccggatttcgtcttcgggatcggccttcttctgaccaggatagtaaagcaatctgaagattgatccagatgggtaatcacgtctgtgtcggtcggcaaaccagtttgatcctcctgaagattcgtcaatcttgagacccatggctagcagtttgagaattctttgtgagaggttgtaaagcttggtctgcatgtttgcaatgatgtcggcattctcgggtttctggaagaactcgggcataggttgaattggcttctcgttgatgtacttgccaaagttgaagccctccttggggtcacccttcttttgggtagcgggatcaagggtctcgacgttgatagcgttgtaacctcggttctcagcaccaatggggaacttgttcttttcctccagaggaagagcgaagaaccccttggacatgttgaacatatcgtccacctccttctgggtgaagcctgatccttccacgaacaggaagccgtctctggaggcgcactcgagcagctcgtccgcagttgtctggttgattgtggatatgtcgacggtcttgacggacattgttagtggtgtttttcaattcaaaaaaagtgatggatctgaaagggtgaatagtctgatttgaagtctttttttcctcgtgcgctccagagccagatccttatcaggccaacccaataggattcaactaatacttaaactctcctgctatgcagcagcgcgcagttgatctgtgtcgtatgtgcggttgttactcgggtcgacaaggagccctggcagcttagacgataatatacgtgaagtgttgaagccggctattggaagagtgtttgatgagatcataaatcgacaaaaatcgtgaaaatcgtacataaaacgccataactatctaatgcctcggtggatccgacggcctagtatcaccaattagcgcttcatattactgatatctgaactttgttgtttagctgtggactccgtggagagaggtctgagtatgtatatatactacatgtatgtgtcagcattgttactcaaatgtggttgagcttagcatccgttgagccacatctagaacggacaatcgatttctgaccacctgctgtgagcatctctcatcggtctagcctactggtaggacatgattttgacatttctggggatgcatctggggtaaggtaaggcaatcaatctacagtcagtatatgtactcgtagcaggtgacagatgaagggatgacagcgtggtgctgtgtacgaatgtagatacattgtacttgtatgcgaaagtgcgtctacatcggaatcagtttggttggttacggcgccagatgagccgcagttccattcaactgcctctttaaatatgtctcaggtctaacgcgttcgtaatcaattttgagatccactttcagcccaaggcttaccagcacactccatagacattcagtcggcagggtaaccaccacacacggaacaagaaagtgtgaacgtgtttgggggtagaatacgcgactttcagacggatacctaaacatgagtgttctggtagtcgtattttgagcgattccaccctaactaattattcatagctacttgtagtacgagacccaagcttctcacagccaagacacacagccactaaaaccacatcacccaatctaaccacaaaccaagttctcacacttgatactgtatccaaaaaggttctcgaggttctaagtctacagtgtgttccgagaataatgagaatatattttcggcacgattaaattgatagatgaagtagtcagccccagtacaacggcccacatgtggatattccatgcaccagaaacgcgctccgacagcccgaaattccacccacacgtgacctaccctagccgctgaaatcttaacacgcacctacatcaccacagcatagactaagcccctaagacgtacagcttgtcacaacactcatcgccatgccgatcaaatcgctggacgcctttgcgacggagcgacggctgttcaagccccaggccctctccggtctcaatggctctattctcggcattgacgcggaccactacttgtctgtcatttccgctctggcagccacctaccctcaggtggtcactggaggatcttctctgccgcccaaggtgcgagacgtgcttcttagggacctcaccaccctcaagtcccacaagattacaccctattttgtcttccgcggacttccggctgcttcggccaacccccacctcttcaagcagtatgacctccaacatgctgagatgcgaagccagcgacgacaggctgcctggaaccagtatgaggctgcatccaccgaggctgagcatgccacactcgcagccttccatgactcgggtctcaaccctgtaaccacctccgcagcggtgttcagaaacatcactggtctcttggcggagaacaatgtggagtactcggtcgccccctactatgcatgggcccagttggcttacctggtcagcaccgaacgcattgatgctgttctgggcccctcagaactgcttctggctccccatgtggacaagattctagtcaccatggatgacaagaacgccagcgtgctccacaagaaggccctgctgcaggaactcggcggtctcactaatgaactttttgttgaggttgctttggccgccggctgtgatctcactggaaactacaccttccctcccttcgagcaccctatcaacgttatgggtcagcccactactccgatccgaaccgctgccgactcgctcgcccagtacccctctatctacaccgctgtggctacctacggcgctgaccagggcgtctttgccgcccggttcagacgtgcatttgcagcattcaaattctgccccgttcttcacgctgacggccatgtcggccctctgccaaacactggcgacgtgcccaacgactcacacgactttctgggccagcgactccccgatgaactcatctactaccagaatgctggtctcattggacctgaccttctcactgtgatcgtgtctggctttgctgctgaagaggccggcctggacggtgacgctgatatcgagtaccgaactcttgtcaagaagctgcccgatacgtactccaagtgtctcaacctcattacccagtctctgcaccgatactatcactacaaaaagtacaacattgtgtatttctggcagcccgagaccgaacacagcctcaattcgcagttccagcctgctctctacgtgggtcttaactggaagaccgacaagcttgatggtctttcttccaagcccgtgagcgctgtcaatgtgtcgtctgtgttggacctcatttcaaacagctctgctgactggaagaaggcttctcttaccactgaccacaaggtgctgctctcaacaaacacacagattcttgcaaacactattttgcgacttcttcagcttgagggctacattgaccccaagactcactctctgaccaagtggggagaggtgctacaggcgttcggaaatgaacctatggctctccccattctatccctgttgagaaacaagctacttgacaacaaacctctgacccctcagtctgtcaccgcctttgctccttctgcctccccacttcttctcaaggtggctggatttgtcaacagcaccagtggcacctacagagggcggttcagccgactggcccttgcgatgtccggtatcgctgccactcagacccgagctactcgatggctcctggaagcaactcttttctctctactttcctatgctgctgacaagggacgagatgcctcagtttacgagcttggtcgagctcttcccttcaacactcttccctcttccatcaccgttaatgtgattgaccagctgcttcgtggagctgctctggaggacgtcgccaaggtgtgctaccacggtgactctgccgccaagattgtttctgaacagcttgctcagttcaaggccgtgtggcaagctcttttcgctgccgccgaaaaggctcatatgcttgacctgatctcggctgatgtgtacaaacagtttgttgaggccaacgacgtgtgcaaaaataagttataatgtctgcgactctgcaataaatgtacttgtagataactctgttgcatgtataagtactcgtagtagtagatatgtgtgccaggcactgtaatgaatggttttgcgggcgaatcgatgtatgaagggcttaatagatgtttcgtattcatcccgtcatggtatggtatgtattgtgtagattgtacgatacttgtttatatggtatcaattcgtacttgtcgagggtatgtgtgtggtgttacagtgtgtactgtagtatgtacgacatacagtgttagctaatgttgtcttaatactcgaagctatggcctgttgtagttatgaatagtctgctttggcacgatagcatgtccatgtctgtgttagtatgcaacactgaatcaagttcagttcagtggtgatagacaggcctccctgctgtcttggcaatggactactgctgtgtccattacatcttccacaagcctttgctctcaacaagtaggagccagcttacatagctactaaacttcgctagtgtaacgtaatatacattgaataaataatgaatgcacgtccataaatagataaataagggaggcgtggggagcgacatccaaaggcagtgaagcccacaggtcgcatcacccacacttggtgattcagatgaactcatcatcgcgtacttctaaacatgctttggcgcgagttgctgagggtggactgagagcccccagcaactgtggcggtggatgcagaagatgcagatgcggcattgttgggagagttggggaatccttcggtgccagaggctacagtgccgcctgatgccatagtattaactgtggccacagtactggctgtggccacagtgctggctgttgagaccgaagacacgcttgctgcagaagacgtgactgcggacgatcccgatcgtgatgatgccacattgggagggttggtggaacaccagtgcttgtggtagttccaagccttaagctgacactctcggctgcagtacttggttcgcttgcaccgtcgacatttggcgaactgacgaggaaattcctcccacttgccacagtcaaagtgagcgcactgtcgaataccgccacgagcctcgttctttcgacacgagtttcgcataatgacaccagcccagtactggatctcattggagtactcccgaatggtgaatttctccacaatagggaacacattaattgtctctccgagaaactcggcacaaatgtcttcctcggactcgaagtcgtaggtatcgtaggccttctcccagtctgtcttcttgcggtgagactttcgtgtcacccgcttgtggaaggccgtgatttcccgctgtttctgagttcgatggtcatccaaaaactgatcgtcaacaacaccatcaacatctgcagtctcatccacgcaaatggactttcccttgtagtcgtcttcatcgtccacatcaacaatcttgacaacagggtctccctcgtgagatccaaacttggatctcatgagaggctgggggactgcggctcgtcgaagtggaggcaggttcttgtctcgaagagacaagtcaggcacgaagtgacatgtctggatgcactccttggtgctgctgtacttggacacataggccagaatctccaatgcccatagcacatcgtcatctcgaggcatcagaatgccgttttcaaaaatacgtggcatggaggcgatggagctctggatggagctaatggcgccctgagcagtaacaggggcgacgccaggaccagggcgaggggtagctgtctggccagtaacagtaggctggccgggctgggcaggctgctgctgttgctgctgttgctgctgttgaggctgggatgcttgcaatcgacgtggctggaaatcatcagatcccatttccacgtcgccgtcggcgtctcgctctgcaaacagagcaaggcccgtatcagtatccaccatctgagcgtcgtcgttctgagactgagacgagttttgggtagcagtgtcgaagctctcgacagaggctcccgaccggagaatcgcactctcactgagcagctgtcggaggctgggggtggtgatggtagtgctgctgttcatgatggttgtggtggtactggaggtcgacgaagcagagtcgatcatggacgaagaaaacgacgactgcaacgacgattctcgggaagacccagcttggggttcgtcagggactgcactctgcgttcggcataggcgcgaaacagacgacactgctgatgaaatggcgctgtgaagtcgacagtctcgtcgcgctgcctgaccctggctctggctctgccccggggtgttttctcgctccttgtctgcagacacctctcgagtcgacccgcagagagaaattccaaaggggttggacgcagtaacagcgtcacttctgtccttgtcgtcggcctgtcgtcgctgcatctcctgctcgacctctgctcgtcgacgttggagctcctgttcggccttggcatcttccatcataagcaggtagttgtcgagcacggtggcgagcactggcagtaggccagcctcgacaatgcgttttcgaatggcctcggtaccgcgagttccgacaaacaccaagcactggaatgctagagcccatttccatgccaccagcaggtttttatcgctgtgcttgtcgtcatgcttgctctcctggcacgttttcataattgccactagtcgttctagaccgccatccgtacatagtgtttctcgcactcgtgctgacgacgatgtgagataggtaaggtggttgagcgagttgataaggggcttgtccgaggtgcagtcgagagctcgtcggtcgtaaagggtcgtcgtgatggtgacggaagccctgttggaagggaccgaccgaaagttggattctcgcatgctccaaacaagaggcgttaccgttgtgaggttccgtaggtggtagttgcctttatgtgtgttgcaagtgtgggtgtgtggcgacgtggcaaagtgactggtgtacttgccgatgtagctatgctgaggatgcggtcgtcgtgtgtcgtgtgtcgtgtgtgttaatgtgacgtgatacggttgtgagagaatgcgcacgctggggtcttgtatctggtgttgcggtaggtctccgcttgtggtgtttcgtttagtcgtgtggttcgtgaggttgccaaaagctaggctgtggagtattgtaatgtcccgtggtgttttttcttgttcaccaactgagtggcaacgataagactatctcctcagacaagtctctatgcgtctccttaagacactccaaaatcgcacgctgttaatgcgtcgtcactctcttaagtgtatgcgaggtggcgagttcgaaaacttttttcccagcttcagacttggctctcgtgtgccaaggatagccagatagagtgtttggaaggagccggttcgggtttaaagtaacgaacggagtagctcgcagaaggaaggtggccaagaagacggcttaagtttggtcgtggaggcggtgatcgagctgtaatagagctgggtgtcgtttccggggttttttgtccctctgttagcccccaatcgcgtaaattagtagtctatgagactttgacgaaagtcaggtcgtttggccacccaacaattagctcccacgccaggtgcatagagtttgcgttttgaaaactcagtccagccacaaagaactcagtggcaaatggtgaatctaaaagcaaggtagatgcggcacatttggctcgccagctgaaactgcatttttgactgtgccattggttggaaagggatagtcatgagaggggtggcgccctaaatgctgctccttgggattccacaatgagagaggggacacgctggctatctcgttcgtgattttttgtgctgcaatcggtttgttcgtgcccaatgttcctcggccgcctgtcatctatggttgatcaccgataaacaatgtggcttactgtacagtcagtaaataacagtggcaatgtatgggccagtattattcttgctccttaagcagcacagtgtcccaatgagtaaacagtatcaagcggcgggaaaagtcggaatcgtcaacaggcaacagcagtataaataggagtgctattggtacgagtacatttacaacaagtacggacgagactgtatacttctcagtttcacattctcagagccaccacacagaaactccttcttgttgacacccagagaatgtgcggctaagtacgcgagtaccacacaagacagctgtacgtaaatacgtacacacccagctatctaaaccgatcccataccaactaaactaaacgtcaaggttgttttacttgttttgtaacaatattacaggcgcaatgctggatccgatcattccatcgggctctcacctaatggcagcctataacggaactttcaggtcccccaacgttacaggctcatacccatgaagatggctacaaggtgggacactatcgggggccgattaataggtttcacttgtatatcgtacaagatggaggcaatgagcaatagggtaaatggatcattgcaacaatcgaacttaagtgagggaaacggcattttagagtcctgtcattggccccggtcgtcccatgtcatatgaggatcgatcgaaactcttggagaggtttgccaccggcaaaacgccccattctgctgcatcggctcccgcaaaaaacgtattgttggtctattgtccaagcaccctcctgtgcatgcatcgcctgattgaccgtgcgtttttcccgctgagttgtgccttgcctgtccaatgctgacaggtgccgttcgccaccctatcaccctttattgttccagttaaggttcgggtgggaaattgagcggaaatttcggccctcgaagatgacgtaaatattgctgggggaagtgaaccagccaattccgaagtcattgaacgattgccaccatttatctggattatctactttattgcttgcaactgtgaaccacggcagaagttattacgtgtccctaaatgccggctcaacggtcatttgggtggcaaaccacaaaatcgaaaccgaaatagaaaatactgtagcaggactcaccatacagtaatgttgctatgtgaattgtgaatcagaggagagagaatcaaaagggttactgaagatatctgagacacgagatagtccccttgtccccttgattgtttgcacaacttctcccaatgtcccctgctcgatccgtgtggcattcttcgggatggttccccgataccaatcacgtgatttgccaccctgggcatagtttttcgtttggaccttctgagggttcagacacactaaaatcaaagttcagataaacctccagcccatggactcctctgtcatatcgcatgtctcatgcataagtcgagtctagagttcttctgggcgatgctacacgcgatcacatctgctcgtatagtcgactagacaagtcatatgcgcttgatttgtcagatatttgtacgctgatggaatgtcgtcatcgattgcgttttgccatcggcacgggttttgttgagcttgtggttgtcaagtgcacttgtatcatatcccctatacatccaccattctggtagcgtaaaaacaaattttcgatttcatctatctggaagcagtgtttcattggagaatctgaaaacaagcacaagctgttacttgtacaagtacttgtacaagcgccattgcattaaaatcgttctgcagaaagatatcgaacttgtagaagtacattgaacgtcgcggtccttcaccacttcctactgtacacgccatagtgtgtaagtctggataacatcatcaataaataattacagtactctattggaaataaacatcaaacagcaattgcagttccttcaagctcttccaaacacaaagagcagctctgcccgagacagagtgctgacctccttcatgagctctctgtcaccgttgatgacagagccggccagcttacgcttcttgtcctgaagctgcatgatcttcttttccacagaatcaaccacgctaaactcgtagacatccacatcgacggtctgaccaattctgtggactcgatcaatagcttgctcggagaccatggggttccaccaggggtccaagagcaccactcggttggcacaagtcagattgagaccgagagcaccacactttagcgaacagagcagcactgtagtatcgggatcagctcgtagagtagcgagggcagcgtctcgcttcctaataggcatgcttccatcgtactttacgtaacggatgttctctcgaatcaggaatggttcaagaacatcaaagaacttggtgaactgactgaaaacaatggtctttcgaggatcagcctttagaagctccagaagcttgacaaccttggcactggcatgtacatccttgccgttaatagacaccttgttgtctccagaagaagtactggagcttccagctccatccatacccatgtcagcaaacatatcagcaagatcatcgaggtctttgccatcgtcggcttcagcagagtaaccctcaaattcgtcgagatgcccacccgtggcagcttccttggagacaagatatcgatggtcacaaatctgccgcaaacgcaagagcagagtcagggcctgcatcatggatccgttggaaatggtgtcaatctgacttccaattcgctcgttaacggcgtcgtagaaagctctctcatcaggctggaactcaatgtcaacctggtgaactcgtcgagccttcatgttcatcttggagtccttgagaacagcttttgttcgtctcaacatgagaccagaaagcacaagatgcagcttcgccattgcagttcgagcggctccctccttggaaagaggcccagagatctgttccttccatacgacaggatcatcgtaaggaggaactcgaatgaactgaagcaaggcttgaagttcatcaatattgttctgaacgggagtacctgtgagacaccatcttcgatcagcgaagactcggcaggcagcctggtacatctgagaccgcttgttcttgatggtatgggcttcatcaagaatgactcgccagaacttgactcccagaagaggagagttgtccttcttgatctcggaggagagtgtctggtaggtggtgacaatgacatcatagtctctaaagacatgagaatcagaggttcgaccaggaccgtggtgcttcagaactctcagaccgggagacttatctttgatttcctgctcccactgagtggccagggacagtggtgcgatgaccagggtagccttgcactctcgaggctcaccgtccttggaagcggtcttcgcatgcagacctcgagggttagatagaatcaaactgatagactgaacagtcttacctagacccatgtcatcacaaagcatgccccccttgtgtttgttggtggggacctctcgtccaagaagccaccgaacacccttccgctgatgttgcataagagtcacagagagtccaggaacaatacccttgaaccgcatgttcttgaggaactcactgtcccaatgttttctgacgagatgacctcgatctcccatctccttctcctgagcagctcgctcctcagaccttcgagaggtggccttcttgctagaagcgcccttctttgtcttgtcttctggctcctcttcctcctcatcagagctctcctcgtcttcgtcattattgcttagaatatagggaagtaacgcttcaacatctccagccgtagatgcaggggtgtagttgaactcgggtgcgggggcagacgagtgggcgttcacgccggttagggcagcgtccttaacaaggccgggagggccacgaacaccatagttgacacgtggagtgttgttgggctggttatatcgatcgtatccagactgctgcttaccagcaccagacatgatggccagttcagactcagagagtccgacagaagcttgctggaatcgctgctgatgctcaatgttctgcttgatgggcgaggaaatggagaaggccgatctggagggaactcgaggtttcatcgactgcttatactcctcgtaggcggctctgtttgcagactccattgagttgctgggggtcttgatgggcgtggaaatgggtttggatgggcgccgcagtccagcagcagaaagatcagacttgggcttgggtttgggggctgcatgcaaatcggggatcttcatgggtgccatgggttcatcatcaaatatgttcttcttggttccagcagtggccttcttggatgctgagagcagagggttggcactgtcaaagacggagtttttgggcgacatggacaatcggttgcgtcgtactggagtagcgacaggccgatcaggttgtggcattcgcttgacgggagaagtgtgacgttggaaatctggtgcaatggccttggggctgtcagacttattaaggataccattcagaccatcctccgagtcgtcagaattgtcagaatcatcagaatcatcagaatcatcagaatcgtcagaatcgccttcttccgagtcgtcgccggagtcgccacctcgactgaggttttcctggtagctcttggtttgccagggcttcgtagttcgaggagcggctgcactgctagcatcgctgtgatcgctatcatcagaacacgattcagtttcatcactgtcagacatgatttggcgtctagaacgggtcgaagggggatgggcatccatcttggcggagagtcgagccatgacggtaggctgtgttggctgtatgttctggcgggtatcaggctgtgtagtgacgatagagacgaggacctatcgaatcgttaagtatttttcttctatgcactatatgcagttaagaaagacaatatgtgcatttgcagcacgtcggacaggacaagtattggcgtttttgctctgaaagtggctgaaaacgggggaaatcgcgtcaatattgctggatgatcatgccatacaatatatgaaacgtcaattgcaagttttgattgattccagtacaactccttttcagctattctcaacaataggtggaagtgttgagtggctgcttaaggttccattgtttacaacgtcacgtggggttgttgccacggttacatacctgagggaagaggaccgttcaaaaaggttctgatggcgaatagaagcgggatcaagacacctatcgtatcgtacaagtacgagtaccacgtgtgtaaaaacataagtagttgagttgtcacacacatccgaaaactattgtcacctacactacaagtagctacgcttaccgatacagtagctcttacccacgttcaaattacgggttgctgtacttactgtattttggttcttcctgcagtgcacacaggctacaatattgacttgtaggaagttggagaggatactgtgtggaagggtccgacatctgtacaatagttaactacagtacgatatcggtaagtacaaaactacaatagtttacactagagctgtctcagatgggagccaatattcatattaaatctccgaatccggggaggggttgagtggggttcaggtcatcttctgaggggtaacgagagtgtgggaagtttgagatgtgatcttgagagacaaacaggctcgaatatacctgtcagtcgctacgacttgacaaagaattgacaaaggatggagacagtggagcctctattgaatcccaaggtcttattgtccacttcggagctctttaattactatacaatactatgcccagctctttaaacaattaactcactttaggacctccaccagacagggtgtgtgatgttaatgcatccgagggtctactcatgccctatggcgacagggtgtgatatcagcagtggctctatcttatggccaacacactaagagaagaggtcacaccgtactgctcgtttgtttcaactcggtccttgctgtttttgcgtcatatatttccgtgtctttgaaggtctcgcatccacccccaattgggtatggttgctgccttgtgccagcctgagttacctctcttgtatgttgatattcattccgtacctggctgcagtgccaaccagtgcaaactgtagaggagaggccaccctgctgacattggagctatagtattatatgaattccccgcctggcgttgcgaatggatggctgtagaaatgtgcatgaattggtgctgaggttacagtggtatgtgggataggggcaacaataacacactgtatcagtacgacacggctatacggcacagtttacactgcaagaacagaacggtacatactgtgacacacattataaccaaacccgagatattaaaacagacaagaaatggtgccttatattatatatttcacgcattagagatggaatcattatagagttggccgcgccgttgaagcttccataggtatcaacacgaagggtttcctatattggctccttacgtacagttaaagtggaatgacttttaagccaagatttcaagatttgtaaggcctttaacacatgggctggccgagagagtggagactttccccctacgagtagaacacgcgagctaaacactacgagtagctactcgtactgtacgcactctgcaccgcggatgtgagactcatcgaggttatacaccagaagtcttcgttggctttacttggcttcctactctgtggagagcgcctgccgttcatctgtacccagaggtaaccgggacaactctcgtctcccggcatgggcgtttgagtttgcaaggctacgatccttgtgtgggtgcggtacgggatttgaggtgggtcttgaccacgcccctgaggtatattccacggcggtcttgtgctggggtcagaagaaaaagtgacactttactcgtagctccatcttaatgtggaggggatctaaaacaatattgcgattgaaccagtaaacaataaaaagacaatatggtgccaagaccacttgtttgtgccctggaactctgacccacacagtccggctgagtctctctgctccctcaaacctcctccactacgattgcatcatgctacattggcccgaagtctgtcagccgagtcgaacaccatcaagcttgagcgggagaaggcgcgaggttaatttcatgcggctgttatgactgtaaacctggggttgactctagggctctactggccccgaaggaaccattgtatacattggttgcgcagtaactctgcctgaagaagacccccccccccccccccaaccgaacagggtattctacaatcatacaagaaggagatattttcgcagctttcttttggctgttcctggagtgtaattttatgtaacacacatggcatggaaacttcgagtctaagtcacgtgcacaataaataaaatatgggattcggtctagacatcaacgagatcatccaaatggaggcgaaacaaacccagggggacagaccccgaagaactacagagagaagatgcctttattccccgtagaatccagacccaaatttccttgtacgctgtttatttgcctcattttattgaaccaatttggccacggctatatcccgcggattaaaactatcatgcagataactcggcttttctcgtctgcgtcactgcacggcacatgcactcatcacatgatacccgatggacagcgtgataaaaggagaagatgatcctcggtttctttatcgtctgcttggtgctccggagcgggcttcacactgggagcatatcgaatgaacagcctccatggctgttcagactgccaagttgggcacaccaagctagaattagctcgttgtcaggcatttattagtcttggctagccctgaccgactcattttcagttaggcttctgacttggtctattttggatactcctacgtagctctgctccgataaacgcaattttcacacggtgactataggacagctactatgactagaacggtggttggccgtgtatacgaggaaaaaagtacatagaagtattcaccagggcaaatgacgcgcccagtccccattttatccttgtagcaagtcccagatgcacagccacatcccatcgttgtgcttcaaacctcctcctgagcttttctctcgctttgcccaaacaaacacacacacgccaacagagtaagcgaaactcagttcattctcacacctattcctctaccaacaactgtcaacaatcgcaaacgacaaccactgggtaagtataagtatacacgacgacacacggagcgttgataccgacgccgtttgaagcccgctggctcgcatgctctactctctctccgtcaggccattactaacgcagcatgactagaaaagacggaggaagggggtccctcgacttcacaacagagggcctcaatgaggcgccgcctcgagtgtcgcaggatgattccaacagtcaacggccacgggaacgaccacatatcacgttctcaccttctactaacgacgtgccgcattcacaacggtcaccaccaccaccacaacaacagccacatagcccccgacggcctcgagggaactctctgagaacacagctttttgagcgtcatcgacaacagcagcagcaacaggcgccagacacgacaaacgacacaagcatggatatatcaggggattacagctgggctacggacccttcagaagatgacctgaaggagggaccgtaccagcgggaggacagttttgaagaggtgactcctcaggacattgacaagagcattgatggtgagtataacctccaacgcagatactttatggacatcctttactaacccagactcggaaccgttagcacgaacgtcctccgttggaagcaaacggttatcgcgtatggcgacccaattttcgactacacccggcaacatttcagagcggctgccaaactacgccctggagaacagcaagcccaactcgttcaaggaaaacctgctctcgtggggtccacagaaacaggtggtcaagtattttggaaaggtgcacgacttcgtgctcaacattcagcatctgcctccctctcgcgatggccgccagttgcctctggaggtgccaacgggaaagagagagcttctggacgagcgacgaaacaagaagttcatcgataacgaaatcaagtcttctatttatacaccgtggtcgttcctgcctcgacagctttacgcccaattctcgaagctggccaacctctacttcttggccgtgtccatcatgcagatgattcccagttggtctaccacgggtacttataccacaatcgcaccactcatgttcttcatttgcgtctccatggcccgcgaaggttacgacgattggcgacgacacagacaggataaggcagaaaactaccggttggccaaggtggcgataaagagggataagggtggaaccatcagtgagaccagcagctcaagaaacatggaacttgactctttctcctctggggactctatatctggcgcctcgccaatcgagttcaaggaggtttattggaaagatatcatggctggagatattgtcaaactcaagcaggacgactggattcctgcagatatgatcgttttgtgggctgacggtatgggcgaccaggcctatatcgagaccatggctctggatggtgaaaccaacttaaaacccagagaagctctacctcagatccaaacgcaatgcagcacggacgcgggactggccaagctcaacggccatctcaacaccgaggatcccaacattgatttgtacaactttgagggtcggttggaatacgagggtgacacatactcgcttggaccccaaaatgtggtataccgaggctccattcttcgaaacactcctaatatgcttggagtggtcatcttcactggtgaagaatctaagattcgaatgaacgccatcaagaaccctcgaaccaaggcaccccgactccagtccatggtcaacaggatcgttatggtcatggtggcatttgtactcattctttctgcattctgcacaggtgcctcttcaatctactaccattccgatggtcgacacatgtggtacctcagaggtctggaagtcggtgttgtgcccaacctgatgggttttatcatcatgtacaacactctgatccccctgtctctgtatgtggcactggagattgtgaaggtctttcagatctacttcattcaatccgacattgacatgtattacattccatccaacaccccttgcgaagcccatactgctacaatcaatgaggagctgggtcaggtgagttacatctttactgacaagactggtactctcactgaaaacctgatggtgttcagaaagatgagtgttggagggcgagcgtggatccacgagctggactgcatgcttgaggctgccaaggccgccaatgcagtcaaggaggcccgaaactccaccgagatgagtaagttggcaggcaaggcaggtgttggagatttgttgatccacaagcctcgacggtctcgaaagtctctccgatagagtatgggcagcatgaagctgaagaagaagtctattgacccgtttgatgattctcaggatagccggtttgcccacaagaattccggtggtatcaaagcttgggatggtagagattctggtgactctgagcggggaggaaaacaatgggatggaagtggtgcctcgggctccaaaccgcggacttccaatgttcgttctatcggaagaccctccaacgccggaggtcggccttctgtagtttttgatcgcactgcagaggtggagcacgagagtcgacctcgaaagtctcagggcattcaatccattcactctccaagacagtctactgatgagcttttccgacaggtcatggcccttcctcgaaaaagtatgactattgagcccacgcagactcagagcagcgaggctgagcctcgactgtctcgggctctgtctacgcgatccctgtggaaggcttctgccgctcccatgaaggatcaggagaaccccaccaccctggacttgctgaactaccttcagaccaaccccaactcggagtactcgattcgtgctaagtttttccttctcaacatggctctgtgtcacatgtgtctccctgagggcaacctggaggagggtattgaatacacctcggcctctccagatgaagttgcccttgtggctgctgctcgggatctcggatacatcatgagcaacagatataactccactgtcactgtgcgaactttccctgacggtttggacgatgatcctgttgacgagacctacgagattctagatgtcatcgagttcacttcaggccgaaagcgcatgagtgttgttgttcgaatgcccaacaatgagctgttcatattctgcaagggagctgataacgtcatcgttgacagacttcgaaactccgcaattgctcatgaaaagattgaccggatctccaaccaggctgctgatcgaaagcgagctgaggccgaggttgttctagaatcccgaaagagtatgggcgctgctacttcccctcgtaagagcggtgttgatactgatgctcgaacttctttcggtatccctcgtccatctattaacctcggtagatctagagaccccttagattccatcgacgactggctctacaagaagactcgagaggaagaggacgtccatgaggttgcatctactgctcgaaagtctgtgcaactcgctcgaaagagaatgtacaacgagccccagcctagacggtctatggatgttcgacagactgctcatcgagtatctatgggacgtgtctctactggccgagtgtctttcgcttatggtgaagagcgtctccctcgaaatatggacgatattctcactcgaaccacacccaagaagaatagtggtggtggtttcgatcatgaagacgctgctggagacttgtctgtcgaatttggtatcgatgacgagctggtcaagaatgatgcctacatcatggagaaaaccctgaaccacattgaggagttttcgaccgagggtctgcgaaccctgatgtatgctcacaagaagctgggccaggaggagtacaagcagtggaagaagctctacgacgatgctcgaacctcgttggagaaccgagccatgaagtgtgagaaggtgggtgagatgattgagcgggattttgagctcagtggagccaccgctatcgaggacaagctgcagaagggtgttcccgagaccattgagaagctgcggcgagccaacatcaagctgtggatgcttacaggtgacaagcgagagactgccatcaacattgggtactcttgtcgtcttatcaaagattattcgacggttgtcattctcaagcatgatgaggatatcgttggagcacttgcccagtctctactcaagcttgacactggcaacgtggcacactgtgtggtggttgtagatggacaaacgctgtcgataatcgaagaggatctcactttgatgagtctgttcattgatctcggtatcaaggccgactcagttatctgctgtcgagctagtccttcacagaaggctctcatggtgaccaacgtgcgttccaaggtcaagtccgctatcactcttgccattggtgatggtgctaacgacattgccatgatccagtctgccgatgttggtattggtatcactggtaaggagggtctgcaggcagctcgatcttcggattttgccattgcgcagttctcttacttgctcaagctgctgcttgtccacggtcactggaactacgaccgaacctgcaagtatgtgttggccactttctacaaggaaatgctcttctacaccacgcaggcaatcttccagtataactccatgttcactggaacatcgatgtacgaacagtggtcgctcgccatgttcaataccctattcacttcactccctgtgattgtgcttggcatttttgagcaggacctgtccgcggctaccctgattgcagttcccgagctttatgctaaaggacagaagaacgaagcattcaactaccttgtttacctcgtgtggatgactattgccatctcacagtctttgattatttcgttcatggccttttacatctggggtttctcaagtctccctgatatcgacaacactctctaccctcttggcatgattacctttaccgctgttgtgttgctgattacacttaagcttcagatgatggatatccagagccgaactgtcattgcgctcggagttaccattatttcgatcggtggttggtttgcatggaacttgttcttgtctgctgtgtaccataatggccgggtgaagatctactacatccccgatggtatggtatctcgatggggtaaggatttgtcttggtgggctgctctcttggtcgtgaccattgcagctgcactggtggacattctgtggaaggtgttccgagtgtggttcttccctactgacacagatttgttccaggagcttgagcaggatgactctatcaagaaacgacttgaagaggaggcctacgaggaattgcagcagggctggcgtcatggtaactgggtggctgatctggaggctcagggagctgatgctcctggcactcctcgaagtagcagaaccagaagtacacgctactcaaactctgtgcgatcccctgccagcccgagatactacgatgagtacactccttacacatcttcatctgggagagagtcatcttctaatgaccatcagtctagaaccgacaaactgcgacagaagctgcgattccctcgtaagaagacttctggtgagtacgagcgtgaggtggaggagattctcaagcgccgagcggaggatgaacggtctcaggctttgagagatatagaaatgaggcgcatggcctagttagacattgcattatttatgaattattttggtggtcttagtttctgtagtcatgagtagaatccgctgtcataatttgtaccagctgaatacctgggcatcctccgtggggcaccaacagtgccacagattggcaatcccgactcggtcttggggagattcaactctgtaggtctgtattcgcgcattctttggaagcggtccatttcatgaaacttgggttgttgtggacccctgagacaggcattcagagcagtattaagacctctttcgagtttcatgattatccgttccatagagagatgatgttctgctacccctatctccactccctcgtcccagtcgctgtcgctatcctcatggatgtagtgttgagtgggtaccaaactcatgtacacggttgaattaacagtatggatgtctggagaggttgatgttactatatagaaaggagtcgtgacattcttggtgttgtggacggcaagattggtgagaggaacagatgaggataccaatgagacacaagtatacaaaatatggctaaataactgtagctcataaagcggttttcactaacgacaggctatactgtaggttagtataactacaatacttgtacagtaggtatccaaacaaacagtctgctttgagttaacagatccccagctcgtacacaagcctttgcgaggtgcagtatactgtagccttcgcagttgaaaatggacaaggacacatatccaaagacattcaccagaatactacaagcactgtatgatgcagatgacaagcgagacacctccacatctgcttccgcaacgcttccgcaactcttccgcaacctgtactggcggaaacattcatgctgcatgtcagaggcatgataaggatctcagtaagtaattggaggatacggtagctacaagcttcatattaaatcagttacgaaaccgaaatatggggtaaaaatccaagaggaaggctctggccagatatttaattagcagtcagaaaaatcaagggtatttggttctatatcacgcgtagggttgacactacgactgttaacggcactgatactagggcaaggtcttatccaaaataagaaggaggatgcgcctttttttggcagggtcccgcgattgtggagatgcgcattaggcgaaatctgaccaaatcaggaaattctatgcgggaatgaactcgtgtatatctcgagaagtagagaagataagagaaacgttgagtatgtattttatagctgaagttgacctcttcgtgttaagacattattccaagcaatacgtgtcattccctggtactttctcctacggcattgctagatcagatcaagccttgaatactaaatgaaactttcaggaacccggggaaatataaaactaccagctttcgctgataagctgggacactaccatccaccttctttgcacaacaatcaacatgcgagcatctattttatatgctgggttcgctcttgcaagcttcatggattccgagtatggtgatctgtccgtcgaacagaagcccatcaaggatcacagtcattcacaccaccatcatgatcacggccacggtcatggaaatggacacgttgaggtagagtatctgaatctcccgggtaacaacttctacgaagatctggatgccgagctcaatggacctctttatgctggcattcaaacctttgctcatctgggacatgtttcgtgctttgatcccaccaactttgcatccgagcaattcgatatcgctctagttggggctccttttgacacagcggtcactttcaggtcgggtgctagattcggaccggctggaatccgaaagggatccagaagaatgtctccaggacaggtcagtccatacagagagggattcatgctctacgacgattgggccaagttcgttgactgtggtgatgttgccatgcatccccttgacaatagatacgcgcttaaccagctctatcgaggaatgagagctattcacaaccacacgacctccactctcaatgccacgcatattcccagagccattcttatgggtggcgatcacactaccacgttgtcagccttgcaggctatctacgagaagattggacctgtttctgtcattcattttgactcccacatcgacacctgggaccccatggttctgggaggcaatgtctcttcatacatgcaggtcaaccatggcacctttttgcattacgctgctgaacgaggctacctcaaccacggacacaacctacacgttggatctcgtgctccctacgtgcgaaaacacggagatattgagcatgataagcactgcggctttgctattgtgaacgctcgagaaatcgacgaagtcggtatcgctggagttgttcagaagatcaaggaccgggtcggaaacaccaacgtctatatttcggttgacattgatgttctcgatcccgtctacgcacctggaactggtactgctgaacccggaggatacactactcgagaatttatgcagattctcgatggccttgagggaatcaacattgttggagctgacgttgtggaagtggctcctgcttacgatggtcctggtgacgttaccttgctggcagcagcacaagtgattgacagtctggcatctctgatggtcatgaatggacccctttctactagacaaagcacaaagtaagatatatgtaacaattgtattataaatcaatctcataatcatcgtatcgtatcgttatctctctctctatctctctctctctcgagttttactctccaagagtcagagccttgttccagaaagtgacctccatcttagtggcagtggcgaagatctcaatgagctcctccagtcgctcaggagacactttcggagcctcctcctccagaagagctcgtccggtctcagtggcacaaccgaacttgggatcaacgtacttgtcgatccaagaagagtaccggttaccgggcttgtactcggggtggttcttaccgtttcgagcagcaattccgtatccaaacagacagggagaagtagcaaactgaagagccagccagtcttcagcagctcctacatcaataaggtatcgggtgtaggcgtagcactggagtccctcctcggagttctcgagctcctcaagagacataccgttctccttgcagtggtcaatatgcagaccaagctcgctctggatagtgtcgatgattacaccagcagcagcggtctgagcaatgttcttggccttgtagccggatagggcggcagctcgagcatagtgtcgcaggtagaggtagtcctgctgcagaaagtagtaataacactccggcttgaggtctcccttagccagctgcataacgaaggggtgctcaacatactgcttccaggcaggtgcaaccttggggtgtgaaagaaggtagtccaggaagtggcccttctggaaaggaagaactcgcatgttgtaggtgtggttgacggggccgtgtcccttaccaatagggtgggcctcaaagatggcgttctggatatactgggttccctcaagaaccgcctggggaatgtccttacccttggccaggttggaggcaatggcagaggctagagtgcaaccggtaccgtgggtagacttggtagtgatataaggcatgacgagctcagtaaagtcctttccatcgtaaagcacatcaatgacgaccttatcagtatcgttttccttggcaggctccttgtccttggtgaacgacagatgtcctcccttgatgagcacccacttggcaccagtcttgtgaatagaaacggctagatccttcatgtcctgaacggtcttgggggtctcaaacttcttcttctcaaggacagaggccagttcgacggcctcgggaatgttgggggtgacaatagtcgccagaccaaacagctccaggtagacagacacgtactcagcagggaagagggtagagccagaggtggagcacagaacagggtcaatgactgaggccttgtttgcgtggtgcttcttcaggtagttggtgacggtggtgatggtctcctgagaagagagcataccagtcttgacaacgtcaacacctacatcggagaagacggcgtccaaacaagcggtgatgaagccctggtcctcaatgggatggatcttctcgactcctgtggtgttctgagcagtgagaccggtaatggttgtcataccgtagcagccatggacggtgatggtcttgagatcggcttcaatgccagctcctccagaggagtccgagccggcaatggtgagaacagagggaggtcgagtatcagtcatgatcgaattgagtcagcgacggtacgaattcacaaaaaagagggacgggctgcgaaatatatacctggcttctggagatgggcgcataaccatgactcaaaaagactcaagttgacgggttaggggacttgaagagactcaatattcgagtctaagaaaacttaaatgtcatattgaggaaccctgttgacgaaaatgagatccgtgtgtcagatacagcaggtgtgcgaatgggtgatttcgagggccaaatgtagaagagaccttacatactcatctatgttcctagaaacgtccattaaacccctctctacaacaaaaacctctgtaataatacttgctgtgaaactctgcttgcgcaggaagagaacagagaaattcagtcaaccagtaatatttatgcacctcacgaagtatcttcctggtacgaatgtatcgggtgtaggtacatactatacgaaggggaaaggaagccacagagacttatttggagctgaataaaagctacatattatagcgcctcatacagttgtcagtctcactagtgacgatccacctgcaaaatgtctctctgtcccaataactgctaattacttatgatgtcccagcatgtgttcccgtgtatgagtctcgtacgtaccccccacacttggtcgtcaccacacattaaagattgggtgcaaccggtataagctcggaagatagaggcaggagcggacaaagcgtgtgtatgaagaacgtgccaatatcctgttggggttccttgttatggtttggatatgattcatttgagtcatttgagtcatttactgagtcacagcttctaaacccctgacttatatggcgtccccaagtttacacaagtagtgtctgatacaagtcttcctagaggtatgagagtatggccctgtaactatagaaatgtgttagctacaataccagtacgaagcgtacaccgtggcgtgttacaaaaggaataattggcgactcacccacttcaccggcgaagcagatatggaacggcacttgaactggctgtatcatggctaaattgacctcagacaagatgccccacaggacctctgtcttgttctcttcgtaattatttttactgtagcttcctcataacaaactgtatgtggacttccaaacagaagtcgaagattaatcagcataattgttacatcatggctgacgttcctctgcctagagcatgtacagtagtctcttataccatctcacataccttttcactttggtcacgtgatcctacgttctgttagggttgtttcataaagcggttcaatcaacaagccgcaattgggagaatattgatcatatagcgactcatgcatgaagacattttctgtaccttaatttaaagactcggttatcagcgatggtaagtaaccgggggtggtggactgggtggatgtgtatcgtggaagtggtctaacaagcggttttaaaacattataattcaagcaacctacagggcctacactaacccaccctactatcttatctgtatgcggcacgtagagacagagaacattctagccgattttccccgctctcgagcttatctgtggcagatcaaatttgaaaagtccgagtgagaccaaaacacacaaccgtacacacgcaccatgagtagacacacatctaccattgttggtctgctgacatgccagaacgagccctacctcaaagctctcactacccgtgtcattgggtgtgaggaagttcccaaaaccaagaagacccctgccaagtacgaggttgagctcgaggacacaatcttgttccctgagggaggaggacagcctgctgatcttggcacattgtcctacgaagagacttccgttcccgtgaactatgtcaagagagatggactcatcgccaagcatgagaccgacagtcccattgaagtaggtactactgtcaatgttgacctggagtgggctcgacgtttcgatcacatgcagcagcacactggtcagcatcttctgtcggccattttcgatactcgaaagcttgagacccttgcatggagcctgggtgacaagttttgttacgttgagttgcccaagcgggtgacccgcgaggaaatggacgccgtccaggctgaggtcaaccgcgtcattcagcaggacctcaagatcactactaccatcattacaaacgaggaagaaaaggctgcagctgatccttctgtagttgagaagatccctgatgattatgatgtcaataacggtgttatccgagtcgttaatatcggagacatagatcataacccctgctgcggtactcatctcaactctactcgagagattggatctgttgctctgttgcatacccaggccatgcgaggctccaattgccgtgtattcttcgtatgcggtgacagggttcacaagtacgcctccgaggctcaccggaccatcaagatggtcaactctcacctctcatgccttactgaggacattgagaataagattttggctctcaaccagaatctcaaggatgcttcgaaccgagagaagatgtggatggccgaggtcgctacttttaccgctcacaatgcgaagcaggatcttgagactaagaacgttgttttcgtgtacaagcccgaggcttctctggatttcctcaacgtcattgcaaaggagattggcgatctcgctgagggtaagactgccattcttgcatgcggccagggtaccgctggaggtgctatcatgatcattggagacaagctcgacgaggtatctgccaaggtcaaggacattgtcgttaatgtcaagggaggtggaaagggccggtggcaaggaaaggtcaccaagtgggacatgggcgctgccgaggctcttgagacttatgctttgagcatttagaaaacccatagtgtacggtacactattatagacgaactggatccttcaaatgaatgccttgattacatgtaagcagtatgagtaagaataacgaataaatagattagtaatgcgaggttggtgctgggggattaatgagatccaaaacatctttggggatgagccctttggttctccatctccatctcagttttctggacagcgaatcccaccacatggggcgagaaggtgaggtaccgacactgctctgtgccattggttggcgagaacgaagctcgtatgaagattgagctttccgcaccgacctcccaaatccagttgaacggtcagggaatgccttgtgtgtacatttcgtgcacacaaactcggagtatttgcaagcgtctcgtttgtccatggactcgaggaagcttgagaactcgtagagaggtgcaaagcaggtggtgcacttcttaatcgatgcttcagggttcttgagtgaacgttcgtagtcggatacaaagtagtcctcgacgaagaccaggggttcgttgttgccacagtcggaggcctgtgcatgcaaggggaaaaatgtcagttctttgtgatcaatgagatccaatttcgacggtctgtggcgcaggaatcctgatcttttacgtctaggaagtgtcgagggcgctcgagactcgatgggtcgcttcttgcgtggcgtttcattgatctcatcgtacactgacgagagagtgatagacaccgtgcgagttatcgagtcgaagcttgttctttgtttcgttggactatctatgctcagctctgtggacttttttggtgtcacaatatcacatgagatgtcaagattctcaaaggctttcagtgtcgaattgcctacaggtgtggaagtctggacttcggagtctcgtctgatgtggaatgtcggaggagaagtccccatgagatagtcttgccgttgtcgcttggccacggagattttaggaagagggcttggagatgctgatgcagagagaggttcgcatgatgcccgagtgataacgcccggagaatagtcgtagtcgtctgtgttttccttttcttcatccatctgtgtttgtggttgagtcggggtgatggtttttgctggccacggagacttggttggggtgagtctcggcgagtctctcatggcctgtttcggggtgcttcgtggagatttcgagagtcgggcaatcagagagacgccggacgccagttttgctgaggggtgttggtgtccaaaagagatctttggtctagactcggtcattgtgtcagggactaggcggggctttagtctagaattatattatcctggtcgaggctaagcagtgaaggtgggtgggtagagaggtgtaagagggcacctatggtcgaagtgatagacagctaggagaactgtatcgaggagacacgatcccttcgggcggtggtcggaatgcgtcaaaggactctgctgtggatttgggtgggtagcggctagtgactgtttggggatctcagggggtttcttgatgctgctcgaggcacatcactcctgcatttgctttgttgacccactgctcgattcgtcaaacactaatagacactgtgaagtagcaatgacacgctggaaacacgggataaataataaactgatgaactaaacaaggaggtcacatgtgagcgaggaatgtaaatattataaatattattcgtaaggactcggtgcagatggaagcctgacctgggtattctgtacatgttctttccatttttaggcctggtgaccgcccatcccaactacaactaagcatatatactgtagcacacacaatagaagcctcacacagtttaattttagtgcttggaaaacaatcatactgcataccgaataggcagattaacacaagtcctgcttcatatatgccaggattgtgacagaagcatgtgggggagactttaatttgcgctacaagtacagtgcccacatagtatgccgtgtcactatcgaaagccttctctcctgttgagctccgctgacacttgaggcggtgttttggattagtcattcttggccaccaaaatcaaacccttaaatgtgcgggcggcatgtatacagcggacctcacgccttacattcgtcatgagttgtaaaactctggactacgtacatttgtctgatttcgaggcagcaaatttttcagaccattctccacgtttttgacttaatccggtacgtcatatccatccgacaatcgcccagtccccaaattggcgcgcacttccagaaacccagctggttgtttgagcggcaaggttgcgtattgagcatgccagttttccgtgtgaagaaataagcagattttttttcattttccatacatcctgtgacagactttctgcatcctgttacagaacgatacaagtgccagcacagtacagtatgtacttgtggtatctctcttttagttatttggtattggcgcacacactcggaaaaatgaggcctcgatgtgcatgaacccaaacgcgtcctcgcgacatgcatacacatacatttcgtgagagctatctctaagtacagtgcttgtactcgtacaagatcaacaccagtccactcagtcttatcaccacaggaaaacaccaagcgacatacagcatgcatccaaagaccgtgccacgggaaatgccgcccgatgaacagagtctggcacttctacaggctgcatgggccaagctggacccactgaacaagggaacgattgcggcgacccagatgttagctgcggtggacgccattgaggctagcttcggaatggtcccgggcaaattcatttcgcgacgcggaaggaaggtcattgcagatttcgcggacgaaaaccccaggaagcgagtcacactggaaaagatggtcaggttgtttgaagcctttgacaagtctgtggagatggaaggggagcagtcagtctcagggtggatgtcacaaaatgaggattactcagactattatggagacgctcaaagggtgtctgaaatacagacacccggcccagaggtggatgttggggcaagccctccagtaagtcccaaagccagttcgcttcacacagaggggtttggtatggaccgagaacaacatggttttcctgatattcttggtgagcttcccgatatcctgcctgaattggatcacccgagccccacgagaacaacgcaatatgccccatttcaaaccacgagtgcatcatcccatgtgaagtatgtcccaaccaacgaaggaagatccacgagtgctacgaccaactacaagccttccaccatctcgccaatgacacaaagaggatcactcacatcgccacaacgagcttctcgccgtggatccactgcttccagcagacccaccacattgaactccacacagaccctgggcaatgagtcttctcgtgatggcttttccatgagtgacagaagcttcaacagaagtacacctctacgcccaaaccgacggagctgggcgaagtccaatgacgaagctttctttgaacgcatgcgaaaagatgatgacgatggtgatgatgatggtgacttttcaatcagcatggcagacggtgacacggactcactcatgaggatcaaccataagcatatgaatgaactacaccagttgagaaactacgcagccttctgtgagactcaaatggaggattctgaactgcgccacgttgatctggaagcttcgatactggcgaagacgaaggagtgccgagagcatgtctccagaacaaaggctcaccaggaaggtctcgagcaagtgtcacaaatgatcaccgagttgacagaaattctgggtcgtaagcacaagagaaattcaaggacgggctccatctcaagtacaccagattctgacgtgctggaagcgtacaagaatcgacttgaggtacagttggaagcattgggaaaatccggggagctacaggaagcggaaattaaacgcttgacaacagagaagatcgagcagcaacaaaaggttgaggctctggaagcccagatcaaatcgctgactgacagcctgaccaaggtcaccgacaatgttaccactatgaaggctaacaaagagcgggaggacttcttagacttcgaagctaggctcaacaaccaagatccaagcgacttctcttccattaacgaaatcttggagcagcagaacctcatcatcaacgatctcaaggagaaactgcttgagaaagaacagaaggaagaacccaaggatatcaagacggaaacggttgctcacgttgagcagtcaaccatttccacagggcttaagaatgccttcaccattattatcatggtcatagctttccacctcatttcggagatcttcttcccttcgaacttacctgaaggcgttctatggtggatgaatgcccccgctcccatcgagcgagtgtttggtgctctggatgcttgggtcgcccgtcacgacgacttcagaatgcctatgtaggggatcaagctgtactaattattaacaacatgcatgcatatataaatatagaaataaattacggtggggttttactcaatggtgttgttattcataaatcataaatcatttaataaaaattatttttctccccatcgatagatgttgccggaattgtctccagcatagagagagatactgggggcgtgaagaagcaaagcgttgatgcgaccttgagaggcagtcgttcgggtggacaacttctccaagttccacttgtcatcgtgggttagcttaaatgtctgtgttagaatgtggttagaatggtgggtggtgttcgaaatatactcacaataatctctcctcgatcgtcgcctacgacgacgaagtagtctccatgccacttgtacgtggggtccgaaatgaaggcagcgcaatagtttgctggtctgcctgttgtgttcaactggcgagtaacaagatgatcatcgttgatggttgtcacaacgatggagtcacttgtcagcagagcaatgtcaccactgatttcgttgacctgaacattgcgaacaccctcggtggtgaatgttcgaatgaacttgaaggtggacaagtcccattggatgaccttgcccacatcatcaagggtgattatgtaattaaaacattctgacactcgaatgtgcgagatacaggcttcatggccacgcagggtgtccaaatgggagagctcatactgcaaagacttgccattcttggtgatgaccagtctgtgaacactcaccagaccagcacggtcagcggtgagaacaagcatgttctccagagcgacaaccagctcaataggtgacaagtgcagaccttcaaacacagtcacaagcctgttatcgttccacacctggaggccatggttacggctatcagcacgcagaacagtaggagggaatccctccacagttacaaccgcgcgctgtcgataagtcaccttaagctgtgaattgtgaacaaacagatcctcaatgacttcgggctcgttggtgttaacagtgaagtcgggctctgtagcaagatcccatgccaccgctccaacatcaccagacttggggtggggtttagtcagaatttgagagggtgtctgtccaaagttgtgaatgattccaatggttgccagtctttccatttcatcctcaatgacctccaagttgatagctcctcggtacgagagatggtggaacacgttgagggaatcgatagcctcaggtccctgttggcgagaaccaaaaatgagatcgatccaaagatgcaaattgtcacggacgtactgagactccagtgcttctcggtttcgctgtacaaaaagtttggggtcgcccttggcccaaggaggaagttccacatcaccaaccttggcatcaccatcattctgacgctgaccaaacgaaaagttgttcgagtttagcagaaactcaggcagaaagaagaactcaggaatgagttcacgcacatcggtggtgttatcacgagaagcagacagccaagccttcttgatggagtagaaaagtcgatcagcatggtcgaaacggccaccctgaagcagcaggtatgaatgcacgaacggctgcaatcgaataaggtaggaggtcacaatcatggccgacgagtaatgagttccatagtggaaggggggacttcgagtgtcgtctagctccaacagcgcttcatatctgttcttgaattcattggcacgatgggaagactgagcacccatgggcttgcttagatctcggaaggtctccggcttgctgaagtttaactcctcactgtcatagtcagccaatacccaagggaatatcgggtactgggtgatatcgttgaatgttcttccagccagagtgttgagaatcatcaagtacgaaaagttggagagctcaccagccatccacttcttggtggggatgtggactgcagaagaagatttagagaagcctagcttctgagagaaagatttggaggacgaatcgagatcacatgcatgtgaaatggcatacaggatgtcatcgttcttgagcttggtacgcattgcatctcccatagctctggtagaccggttgttcagaagcttgttggagatagcgtctctcacacgaggagtagcagcagtcagcaacaaactgcatccgttagtgaaaaagatctcaatagctacatcacggagaaggaatcgcctcttggtgacttgcagaatggattccaaggggaacttgagcgccaaagaagcagctccaccagaattagatgtagcgggttcggccactccactcttctcacccgaaataattcgcaagaaggggtctctctctgcgatgggagcttcggaagcgttgacaacctcaccatcggatcgatgaaagtacttgtcgacaacgtacaagttgaaggcaccaagaataagaagtccctcagtagcctcaactccaacaatacgtccgacgttccagaagtccacaatggtgtcaccgggctccaacattcggatgacctttctgttcttgtcctcgacaggcgaatcatcaatgtgattgaagtcatcaataacctcaaacgactcctcatctagggacgaattgagactagtcgattcgtcaccaatagcagtaccagcagagccggtaggaacaatggaattgctaccagcaacatccttggattcatctccttcgacctcgtcaagctcagcgtccccaccatcgattagatgcctgtccatgtagccttgaatccactcagactcatcagggaccacctttttgtgcattcggatacggccttccgacaagtccagacgccatgaagacacattggacgatccattgagtctaccagcctcagcatcaacacgagcgtgctggtcaagcaacatttggtagtgctcatgtttgtcctgaatgttcctatggaacttgaccttttccgagtccagaatagacagttgccagttgacaatgttgtttcgataagtctggtacaccatagactccatggcatgatgagtacctagcgtatccagcttgagctctgaagcagattcctcggaagccagaagctccttgcctcgttcatagactgtcggaaggatgaaagagtcgaaatcaggtcgaacctcagcaacccatccgatagcctcgtcgttggtcatcacggccagctcggacagaaagctgcagatctcaccaccatggttacgactaaactggtgacaggcagccgggacatcatcagtcttcacaacgaatacagctctcaagaaatcaaacaaatagcgttgatcaatgttgggaatggttagcaaccgatacacctgagtgatcaggtctcccagaacgcgggtgtctcgcaagtccgcaagcaggaaattctggtatttgatgatttggcgaagaatactattgccagctcgagcagtggatgctgtaacgagacatcggaaagtcagtgcaacgtagattcgcacaagactagatttagtctggtagagggccttggaaagcttagaaaatccatgcacattagacaatcgtgcaagaatagatccaatggaggtgaatagtagctccatcttctccgtagcagcgccagtctcaatatggtacttgctgtactgggacaagaattgtcctgcgttggtaaaacaccgaggttcgaagagaatactagactcgcagttaacaatagctgctagaatgtcttcaccacaaagagtgttgattacgtggttaccttcaggtccaacagagtcccaaaactccccgaaatcacgtctgctccatacaagatccaagagtatgtttcgtaaatgggtcttcatcagatcgtgcaggcggccggacttgtcaccaaacttatcatcgtccttaaacaaagcgtaagtcattcgacaacttccctcgagatacactcggaaagtggtgagcttgcagaagtcaccattggtatgccgaagttcgtcatagctgctcataatatcgaaaatgtattcctccacattctttgaatcttccgaaccaggctccaactggcgatatgcctcacaagcaaacaccatcatctcattaagaaccagaatagcttcagggacattgatgatggcgctagcatggtaaagctggtgaaagtactcaggaagggagcacttgagggtctcaggggtgaaaggtaagccaaacagcaaggacagaccgagaatccagacttctgacacctgccaccatcttcccagctgagctgtcatgagtgtaattcctctagtagcccgaatgaatttcttcttgaaagcagggcctctactggagagtaccagagacaagagatggaggccgttaacaacaacctcggggttctggtcatcgagaagagaaaggaaccacttgatggtgacagtcctagaaagctttcgagcgaattgcgtcacatcaacctgacaagcggctcgaacgaacgcttccaggaccaacattccctgttctcttctactgttagttatggccatgtgaccagacagtggctggcccagacggttgtaagggagtgcttgcttcactgagatggaatcgctcagggcgaaggtgatgaacaaggtaattgaccgcattacttcactggagtaattggcacaaatgatagccgtcagggttttgcagagatcaggatagatatcgttgggaaacacttcggccttcacagcctgcaggaatgttttcatcacacctgtgttagtaaaagtcgtttttaacaagtttgcaacaatactcacgcattttcaccagtctagtgacgttaaagtcatgctcacggctggtacagaataccacaaactgatgtaataaaagcttgagggtctgcgtagagctgcccttccagatgtcgaattcgaggatcaaagccaagtacgccatagggtttatgatgatggagtcatcagtagactcagagacaaacccaacaaaatcaagaagaatgcttaggtgacggacaccaatgatctcctccttcgtcttcagaatcatcgcaagaatgctgtatccctccttgtgctcagcttcatcagacatcttccaagatgattgcaaggtagagcagaagatgcggagcgccgtcctcagctgttcgggagtagaagcgttttccaccagttgcagcaagacatgcaatccaccgtatgggtagatggccttgtccacaggcgatgttgacacaacataggccccaccttccatgatacccatgtactcctttgatttggtttcatcagattgcttgtcatcaacggtgttgacaactagtgtcttcaaggagcagttcagatctgtggagtaatgaggattacaggttagaacaatggcatgctgaggaatagacaatgctggagggccaggcaagctgtgggacgtgaccgagccggaagagtcagtttcatttctttcaagttctaacaaagatgcaccttcgtatgtcagaaacttgctcaggttgtcctgataggaaccataataaccgggccccaagtaatgaaggaatgagactgtctgatcagtgattgccgtgtctgtgatgaggagagagccaatgcggatgcttccattggactggtcctgacgatcacctccaagtcttacactgaccgtgttcttctggatagatcgggctaccacagacactgtgtcctgtatgacactgtcgagatagcagtaaatcttactcttctcgtaaacaagagtcaccagtgtccatcgaccaagcggaatgtctcctttgacactgtgagtgtaattgccccattggatatgcagggagctgtgcttgtcgtctgacttgacgctggctttgatgagactttgttgaaagtcgtaaatgtcgatgatggtagacgacgtgtttctgtctattttcacccacacactaatagaatactctccagaagcgggaggaaaccgtttgtgtagctttctgaactcgaagtaagactccggtccaaagtagaaatgcgagggctcaaccgctaactcagatgtccattgagacagcttgtcggcatgctccggcttgtcagctttttttaacagtctcgccaccaccgttggatccacaccatattggtcaaagtgtttagccagtggcacaagcagcttctctggtccggagagatctttgtcaagcgccttgacagatagatcatgaacgtgtctggcaagtccaacatggttgaatagcgccacagagtaagggtacttcgctagactgttgtgcacagcgttaaccaatggcggcagctgcggtggctctgtttccaagagatacagcgtcagaatctcagcactgatagtgttgtcaattctcccgtcctcctcaatcagacactcgagcaaagtatcaatgaatccctctgttgaactgtgagtgtcaaggcactgctttaacatgtcaatccccgtgccttgtctgaaataggtgcaattggcatcatttgaccgcagagccgagcatagaatctgaagatactctttgagaccgctttcggccacaaatagcttctccatgatcagctcaaacccatatgagctgcaaaagacagcctggctggctccgcccaaggctaggctggaagtgagtttttcggcagataagggaatttcatccaaccgtagttgctgtagcaaagacgatatatcgtcggacattttctcgggcgtgtaatccgtagatatcgaaagattctcggtagtgtgttggagtagctttggctgtcgtactcacaagtgtatatgcgtcaacctagtttatcgtgcaggaagcgaggggtgatagcccgcaagatgaaggtcaattcgccacgtatatttggtagtgattatgtgtctatattgcagagggagtttttggtcactctatacttcttacgtaggcatctctcacaacatgacacttgcgcttccaccacttttcgactcttacctgggttggggtcatgtgacctgcagtcccgcgtggttacatgttatcatagacaaggagcactggaaattggtccacttcagaaccactgtacttgctgttgatgaacggtctggtctgatcaaacgggatatattttggatgcataacaacataatatttatcaccacgtgcacaccatggagctgtcagaaaactcacgcgccgaaggctctaataatacgggatatttataggcctgaacctacactacaagtgtattgtaccggtatacgtaaccgaaagcaattaactacggtacgatatttgtagactaccacaagtagtacaagtacgagtatcttatagtactcgtacggtacttttgctggttgattgacagctcataactgaactcgaacacagtgatgtaaccagttgaagtgacttagaatgggaagagtcgatagattaataaataggtaaataaatagtgtaccgtggtctaaccaccgtagtcgtagcagtcgtgactatacccagaggcaccatcttgtgaatgatctgctgcatgatgtccttctccgtcgggaggtcggctctcccactcatagtaactgtctggaaagacccggtatgatctctggaacaggtgggtttcagcgctgttcccacggttcgacttctgcaaagtggatcgtcgccagtcctccttctccttcatctcataccgcgagatcaatgcatatgggggctccttgaagatatcctcgtagtcacagaagggacagatccacgtctccttttctttttctttttctttttcttcgttttccgtgttcttgtgcaccctgttcacctttcgtttttccttcatgtactttctccgacttcggttcacgaacctcacccgtcttttcgaatacgtccactggggaacctgggtttgtggcaggttatcaataggagtctgtgtttcagcatgtgtgtatgtaggtttcagcggggtcgtcacttgtccaatacctgattcttgagaatgaaaatcaaacgagtagaaaccatgtccttcaaacagatctgccacatgtgacagtgggctgtctgtcttaccataccccactcgagccgatcgtcgcgaagggggaagctggggtccatcatgctggattcctacgctcacaaactgtttctcttctggtttcgggaaggacttcgacttgtctgagctccggatcttgcggttgatgtattcagtccaattcccggcatggtcccccgacagtcgaatatcttcttcttcgtttgctgcgctgggcgtggataaaaggagcggcagactgaatatggacctggaggcggctctctggcctcgcctcctagaacgaataggtaaaattcgcctctccacactcatggagaggaagagcagtgtgcgtcacactccacagcagtacagtaggtacatccgtatagggtttgggcacgtgtgagataggggctgatggtaagacattcggttcgagattcagtgatgtgagtataatcaagtaattgcaactactgtaagtacgatggtgatacgaagtaattggttccacatatcaacggctgacaggcaagtgaagtaaggtgagagttcaggacaaaatgctacacaactacaactggagatacacaatgataccatttattatgctagtattaatgcgacggtctagacgaatggtgtctagaagaagactctacacgagtggacgttgcggcgagcttccgtgcagcgtcactaccgtgaggaatgaatgacaaccggctagtagaggcaaaattagggacaactttcttgcgcttgacccgaacgctctcctgatcatgatcaggcgcgtaaatccactggacacagtctcgaagaatttctcgactaatgtccatctcgagctggaactcagcttcccgcattcgagattcaaagatctcacagccctcaatcagaggctcacgcttgtggcgctcctggtatcgcttgaacttgattatggacttgaagtctgtgatctgtgtacatcctcgaagttcaaggacagccaggttggaggtgtagggaaggatacgagggatagagtcattggtaaggagggtgcatccgttaagagagagtcggtctagagaatggcctctgtaccatgcgagctcccacattgacttgtcgcacacaaagcatcctgccgcacccaaagtattaacctgagtctttcgagcaattgcagagatacctcggtatgagatgagatgacccatttgggttcgaccaacgttgagcagcttcaactgaggacatttgccagcgagagccacaagaccttcgtttgagaccttctcacaggcacggagatcagcaatctgcagacgaggacagttctcagcaaccaatttcaggaatgcatcatcaactttggtacagccaggaagcacgatcttctgaagagaaccaccagccaggagaccaagggggggtacaatggcagcacaggtgtagaactccagccactcgagagctccaccaatcttgtgctgaagcagatcaatttcactctgctgagcgtttgagatcttatgcaaaacaaatagcttggtgggggtgtcaaagtagtcgttcatttcagcctcaccgttagcaagctgatgcagattgggctggccggtagaacgagaaagagaccgatggtgactagaacgagaccaagtgatcaagtcttcgggggaccctgtatcactgctcatatgaacaaactgacgccacttctgagagtcgcaaaagtgcaacttgttgtagagaagcttccgagagacctcgaaccagaatttattcaccaacaggcacccgtgtagcgcaccgtcacccttgaacatctgctgggtgggggtctgttcctccttcaatgcccgttcccaggcctggtgggccttctccctgtctccgtaaattagaaatgcgtgtctgagagataggggacgtcttctctgtggcggaggctcatggggcacctgaacgtctgcttcaacatggctcaaaatattgtacagaatctcggggatgcgcagagccttgtggcactgagaagaggtagaatctgcggaggaagagaactccgaatgaacatcggtttcagacaggcaaaagtcatcctcactgttattgaattcctcaaaatcgagctcttgaacttccttgattcggtttcggttccgatcaataaacggatcctctctgagcgacgaggtgtacttgaagggttgagtctgatagtaactcgtagtccgtcctttggcacggtgaataggctgaataggtgaactttcgggagtctgctcgggagtcaaaagcccattgttagatatggcagaaacgccgtaattgctcgtatcaagtctaggcggaggatggcgctgctgaggtcgagttccaccgttgtttcgctcgaccatccatcccatgagactttcctgagggttggccagaggctgcgctggaggtgcatagactggtggttctcggtcatcaatacggccagaaatggacctcactcgctcggcagcacccagagtgagacttgcaagtttccctcgaagtccccggcggctcggggtaggagaagacgggcttttgggcagctgggaaggtctctgaggacttgtgttgggagttgtcccggtagaactggacgatgcaaaggaggaagacgaagcgggagtgtcttcagggctgccaaatatcaaagcagatggagtcgagtaggacctccgttgctgtgtggttgaccagtcgcccttggaccgcttaggcgtagacggttgcatggcggagtaagagttgggggatgttgtatggttgttagctgaaattaatgtcgaattatgatgctattgggctgaaattatcttgtcgtcgtatgtggcgatgctggtgtaattaccggtgtatctgtgtcgaaaaactcctccaactcgccagcgagtcctatcctcagttggtacagaagagagagcaagagaaccagggggtatcgttagtataagaggatgcacttcaaattgtaacgtcaataagcgttgcacgaatagatcagggaatccagcataggaggatgcaaaagaaaccacagggctggctcccgtcctcattggaacaagtcattagtgtagctacagaggattgggtttgaggaaacccctggctttgtgttaggctacatgaggcatgcaaggaaattatcggttagagttggggtggctggacatcccgactgagggagagagagtagcaacaggccaagtgggacagaacacatgtgtttcagctaacgcagctggggacggtagctcataaaagctgctttaggtgattgttaaaaattttcactccagcgtcccttgtttgcaagttgctcacttagtggatacgctgcaatgtctagaggtccttgtgtggagcttcaatgtggagcttgcatcggtgtggtctttcttgtgtggcaggtaagtttggttcggccacagttgggactcctatgcaacggatgtatacttgggagtagttaatcactcgtttttctcgcagcagcaggcctagcatctgcaaaaacctgggccgtcacagtgtagcaatttgcgcttgcatccccaggttagaaccagccacgaaccttggacattttgattgggaccttatctgcttgggttaggccttgataacttctcttagaccaaaaataagaggaaagattggatctgggcgctttttaatcgtcggcgacaggacaactgattttgattaattcacgttctcacggcgaatattattgagtgaataataatgggtaaaatctccagagattgtcctctatctgcatgatgctggaacccccgtttggctttttgaaatgcggctggttaagcattagagctgggctccacggcacaatggggacaggcaattgggggctttctttttccactttatcgccctctgtcacggcagagacagaattagcaagtgagacatacgggcggtagaaaccgaaatagaacaagcactctgccctggtaggtggtgggtcggactgtcctcttttgcacgagctctaccaagtcgtaagtcgtattattttatattatacaagtcaggcgatactacaactatgcacttgtatgtactgtactgtggactgtactcgtaccggtacaagcccccagtagttacgcgccattgaccaacaggcatcttcacacacaaacctactcaacagacatccgcactgtagatccttctcaattattgaacgatcacacgtagaaagcacagactgaggctggtcctgcctcactccgaggcttggtgtatcacgcgatgcggttacagtaatctcgtactccactcctgccacctcgcagtggttttgcctcatcggggtctaatatctaatttgtatcacaccccgcaaattagccatctcctgtgaaacaagcctgaagctccctcttcagtcccattttactctggaccagtaagacgagaagacaaaagtggcggctgcgttgttgcttgtatggatatatttgtaggacccccttctgggtagacgctgtatactttgtctccaggtcgagaacattgcctacaatactacaagtactgtaggcgattgtgctcttgctcgtgacagggcaataatataggtgaaattatgtctgtcaggtcaatcagcgggcacttttcaactcaactaccgaacactattgcctaagtaagtattctttatagtgatggctgtgaagtcgctggaaagctggtgatgcaagcaagatatcactacagtaaaaataagacagaacctttcatttcccctgtgtttaatctcacggcctccttaaccgcgcaagtacaagggaataggagttgggccactgtataccgaaataccctacaagtagggtgcgaccgaggcacatcgaaagcgaaaagggggcaactatggtactcctacggagggccctataaagtgaatgcaagccacagaatatcctcctaccttacaagtgctggtctaagtcacatgactggaaacataccagcaagtggaggggatctaagcaacgagtcggaatattccggatcgtcttcggatcgtcctatcacaccgttatccgtctacactgtacgatcgtacatactacccctactccttcttgtagtcgacaggtaagtacagatagaaacggttgggatgagctgcatgctgcaacttctggcacacgtaaacatgccggacgtgtttacagttcaaagtaatatcatcaacatgagtcgacgaagagcacctgtgaagagcgaccgtatcgaggaactcggcgatgaggaggtcatcacccgagtcgaaaccaacgtgtcttattccacaaccatccccaccaagaagactgcttcttcgaataccacagacaatggattctctctgtttgacatcatcagatcactgggctttctgctctttctgggtgccactctgagctactacattactggaacctgggcctggggctacgagactcagctgacgaaccctgcgtatcttcgacattccttcaaacacaacattttgggcgcaccttacctgaatcttacagatgatcaactgagtgtttacgatggaactagggctggagaacccatttatgttggtgttggaggcaaggtctacgacgtctcagccaaccccttgacctatggacccggtggcccctaccacttctttgctggacgagatgctgcccgagccttttcaaccggctgtttccagactgatctgacctgggatgtccgtggtctggaccccgacactgtggcgaaggacatccgaggctggcagcgattctttgagaagaacaaaaagtacttctacgttggccaggttgtgcatcctgagcccagcggtgagcctccaaagttctgccagggtcaaaaaatgcctggaggaaggcattaagagttgcgagtaattgacagcacccatgctgtctcattatagctttgtggctcctccttgctttttagaacgctctgtctgggctgtgcacacgcaccacatgcgccagtagattgaggtaacggcacctacattctctgattgatagcgatatcttctgtgaatatatggtatacgatggaatgcctgctgtacagaacaaaggaaaccgtacatacaactactgtgtttcaagcgcaccaaaccctcctactatcggactccatgacaagaggaactaatctgcgtatcgcaagagcattgggtccacgcctccaatatcaggataggtagcctacagtacatactgtacacaacagtccgaaaccgtatcgtagtctgagcagtctaaaattaccacagtagaccccttaatacagggacgccgagatactggcatttaaccacttgttaactggtgctggaagacacgcaatagtaaaacgtggtggcgctgagttttgttagcctgctatttagctgggcttgtatctgtaccggtacggtgtcggtacgtgcaactcgcttcctgctgcctacttgtaccgatacaagtacaagggacaggtagttcggagaagtcgataagtctacaaggtgaccttgcattagtgcagcactagacaccaccagatgcgtcccttgtgccgtctcctacttgtagggggttggggccagtatttttacagtggcctagcaatcgctacaagtactcgtactgcagacctctggcctatccattcctactcgactttgacagactgtctcacccgataagctctcagtcctgcaaagccgtttggtggccatgttttgagctgcagttgagaggtcttttgaagatgaagaccaaacaacctataggcattcggtgaagaaaaacaggttacattggtgacttatagaacccgggacactaatactctagaaaaagagagcagggagaaaatacacagccagtagactcgccaccatcgtcacaaaattgtattttgggtcccactgttacatctatggcactcccattgctaaactctagctagtgccgtgcgtaaattcatgcagtctctagacatttggccatttggggagggagcagttgaactattaaaaaccggagtcgacttttctacgttaagggcaactggatcttcatcacacggccaccatgtcctacagaaagatatttggcaaaaagaaagataaggagcccgaggagggcgcacccagacctcgacctgaagacgcccagagcgtcagtacagcgggcacagctggcagcagttatatgtcctcgattttttcgcggaataccagaaatacatcggggactgcttctacatccgcttcagctggctccacgggcagcgccagaagctatcacaaggagggagcagctgcgggacgagtcaacgtgttggagactatcagcgatgtggcagatacggttggagtggacgtgcctcaacaggtgaaaagaggacagttcggtacaagcgacagaaaccacggtatttccgccagccagcctagtttgtcttcgccaaatgcttacctgggcgctggaagccctacaaacctcttctctggagccccttctagtggaggagcctcttctcctgtgtttcccttcgcggtgaatgaggttcacatgcgagaagtccacgaaagcttggctcagctgaacgctgagtccagcgcgctactgcaacacatattcaacggtgtatttactccagttatggcgtctactgccttgcagagactcatgagagactttatcaatttcaccgaaatggcctctgacgtgactgtgcaacagctggcacccaccatcaaggtggtactccatctgagtgataacctgcttggtcccgaagatatccagtcgagaaaattactgctacgtaccctgcatgaactgggccgtcgtatcggggtcttacctcgactctcgggcaccgtcagcgagcctcgaaattttgctattggcgaaatggcctccgaacttgaagcgttgccacaggttctgcgaatcatggaccagatttgcactgcccaaagcgaggtggcagaccaagacggtgccttcattgcaccagttcttcgtggtcttacaccccaattctccgtcctcacactctcttttggatacccgcagccggagcagtctcactacgatatggtgtctcaattaagtacctcgtcgccacaaagtgtccatctttactgccacaaaaaccagattgctgcttgtgcaaacttcaagcctccctatagaatccccacggaccctcagtcgccacccatgtctctttccatcgcatctaacgacggtacggcatcaggaaccctcggcggattcatctaccccaaaattagcgccaacgaccctgctctggctgcctacgctcgttctacctttgccatgacctgcggtcatgtctgtctctccgagaaaaccgggcagaatccccctgtctcagcaccctcccctgtgctcatcaacatgtaccgtgctgctctgaagaaggaacaggtgaaatacgctccaaacacggctgcatacacacagtttcagaatgctatcgacgagaccaagggtcccaacactttggggtctgttgtttggggtgaacgagctgttgtcaacggagccatttccgatgtggctatcatcaagtgtgacactggtcttacatgccgaaacactctgggtgacgatgtcgtcttcaccgagtatgaccctgctcttgtttttggtaacctcgaggttcgatcggtggcccagaagcttgttcccggaatgaatgttttcaagtacggctctacatcaagatacactaggggtgtatacaacggccccaaaattgtctactgggctgagggacgaattcagagcagcgaattcgtggtcaccacagactcaactcccatgtttgctcttggaggagacagtggtgcctggcttcttcacaaggtcgagtccgagaacccttcgctgagtgttatgggtatgcttcactctcacgatggagaggtcaagcagtttggactcttctcacccatgaatgttatccttgatagactcgagcaggttactcatgtcaagtggggagtggtgggaactaccgacgacgagggggaggacctcgcaggggggagtgacagtgatgccagcgaacacaaccacagcgattaggtaagcctttaggatgaggtggtgggaaccgccacctcacaaaagccgacgcgggtgctcaaaagcctattggctcatttggtgagaggcctaatgacgtcaccataaggccacttccacgcaacacaacacacatgttattatggtacgacaccttggccacttataatacattgtggtggatcaattgagctcgtttgatggcctagtctaatcttttatgatgggacgcgtttctatactggaagcgtccctcgttaacactgacaccccaggcggttttgagcaatcacagtcgcactgactatatatttatgtatcaattaatgcctatttatcgattagacaaagagcagaccagtaaagagagcgagagtgacctcgggaacaccaacaatgctctgctttttgatgtgtcgctgggtctgtcgtcggtaagaccacacagagagaccagtgaagcagatggcaccggtgacgtagatgtatccgagagagattttcgcccagcagttgaagacgcagttgacctccttgtcggtcatctcaccgacaagaccggtgtatcgggcccacatgacagccaggggtccgaggggctcaacaactcgcttgaacaggggaaacagcagggtgataggagagtaccactcattgagggtgatgttggagatgtcgaacttcttggccagcttgttctcgcactcgcagctctcaagagacttgtttttcaggagtgcaacgcctcgagcagtgtgaatggcagcaacaacggggaaggcagcagcaaacagagtgtagccagcaacggtgccggtgaactggtagaaggaaggctccttgatgagtgtcttgacggtgtcgcagaatcgagtcattgtcaatgtgttgtttttcagttgtctagaaggtgtgagaatagtgttgagtgacctgtcacatgggtttgttggatggggttagggaagcaatgttccgccttagacgagaaggatagacttttgaatatgcaggacctgcattatctactggaggcgaagacattcaaaaggacatattgtagcttgtattttggcaaatcgctcaacccataaccacgtttgcttggtgtggatttctttgtgtctttttgatatctttggccttgttctcatggacctaaattctctgtgtggagttactttgccacagtggcaaaacgaccaagcgaaagtgagttaaggtgcagcacggttagtaatggaccctttgattggccacagttttgtctggacaactcaacaaccgctggaatagcgatactagaggtttatctacgacgagaatggttttgtagaggaatcaccagaagaatctgaaacagtagaaaaaccaatggcaagtaaagttgcaagccgttgcattttagaaatgtaacaatgaaaccatctgaaagtcaaacatgtcgccatggtagtcccggcagacatggagctctcgcgaccccctacaacagttgtttcctttaacaagcacccactgtaattaccgtatgtactgtaagtggggttttgaattattttacaggccatctcataatgactacttgtaggggctgtttattctgtttattacacccctggccaacttgggacaagcacaagggctacgaacattgatatttctctcacccactttaaaaacatgacatcaaatccaccgtatattacaatctatatattttaatactccatgagtactttaagttgtttgttgcctatgtacgccgtttcttgtactggactgatcgagcacctccatccttgggtcctcgtcgcttagaagcacccttggcatcctcctttatttcgtaggggttaaactgtttcttctccttggccttctgttttcgggcagtcatggcagccttcttctcggcggccttctgatcgtcggacttgagaatagaagcaccagcagagtagtcaaacggagtgaactcctcggacttctcctttgctactcccttcttagcctccttgtcagctgtgtacttcttgttagacttggcaataatgatatcattggcatgctcgtgctcatcttcagagtaatcagactcgtcgtcagcagcggcatcctgctcaaccttgacctcctcctcagcgttctggacttcgctatcagattcagtagagtcaacagataggggtgcgacgggaaccgccaaaaccatcatatgcttatcaatcttggaaacaccaagaggacctagagcagtctcctttacatgtacaatagacgacttggaagagtcgaatttgcctgtgatatctgactgtccgtcctgggctgccaggaagatgacctctgcgatttcagaaaactctgccccctcaatagactcggcagcgaggacgggctcctcctcaacctgctctacctcaacatgctcgtccttggaatccttgatgacgtccagaatctcctcaacgttttttcgaacaagaagcgggagagacttggatacactgaacacagcctcgggcgtttgaggcattcggttggcaagtgaaacgagcagatagttaggcatcacgtagccagtagactcgtcctcctttcgagccatgctgtctctccacaagaaaagagccttggcgactgagacactaggcccagtgatgtggaactgagaaatgagacgattgatacctccctcgtagtcgaacgacttgagatagtaccttgggtcgtagccggtgtactcatacctctgggaagcagtctgtctgctcttttccaaaactccctcgatcttgtccttctgcacgagcgcattcttcagctgatcgtagatgttgagcaggaagtgggtatctgctcgggcgtagagaagctgctcaggcgacataggtcgaattcgccagtcactgagttggtacttcttagaagtgacgaagttggcgtaatgctggagaaggaacgctaaactgtgtcccttgaggccaagggcctgggcggcatggaaggtgtcgaacagagacacaatgtacagaccgaaatctctttggagccactgaatatccatagtggctccatgcaaaaccttgacaatcttggggtcagtcaaaacctcattgaagatctcgaggtttcggagagcgatggtgtcgatgatgtaatcttgctcccgagaggaaacctgcacaagacatgtgatgccgtagtatgttcgcatggaatgatgttcgacatcgatggctatctcctcctgggtcttcaggtggtcaaccatgtctctgagtttctcctctgtgtcaacgtagatgtattcatcctctccttcagcctcccatggtcggttaggaatgacctctgtctcctcgtacacctcatctgggtagggctgctccattatctccttggcgtagggctgtgggtagtgatctcgtctgtcatcttcagtcaccaattcgaacgcgtcctctaggggctccagagcatttggtttcgaggtgagtttgggtttgaagggagtgtctctcgaattgtcgacctcccacatctcctggggcttccattgcggccccttgatctcgctagatgactgaatggcatttcctactcggatcttctctccgagcgtctgagggccagtcttcttggactcggcaatctcaaccttgtctccctttttgttcagctttccgagctgaatgtcggttttctcgtacaggtcatcgacaacagacgagaactcattccagtgtcggttcacagtgtcgagctcgggaggaaaagatcccacttcgttcggggcaatcttctgggccagctggttgaccactccaatgagctgtgatgcattctccttcacgctgtcggccaccttgtcatcaatagagctgtagaacttgatgtcgtgcgaagcaagaccacgggcagccttggcagtctgttgggccagtcgcacaacactatcgatttccatcttgtatgtgttgtggtgatgggaatggactgggaataggctgttggaaaattgatgcatatacagagaaataatttacgattaggtttagggctagctaacacaaatcgggtagtaatacggtacatactatacttgaagttggagggtccagcggatatggtgaagtgatagacaggtattctcttatccgtcctactctattcgacgagcggattttttttattttttgtcagtctctttggtgcaaccaccgaaatctctctctactatactgcttgtgctgttctacgacgtgcatacttgtattacttgtaggtcgtctagctagattgtctataccgaatcttttatgtacaatgggtgctcatacaaacgacccagttatctattcttcatcttcagcctcctccaccagctccacgatatcggttccaggaatcagacgaatggtcacatctgtctctcctgcaatgatgccccacatgatggatccatcccattgttctgcaatgtcattgtagagaccttccaggatatctgggtcgttggacccctctccaagaacctccttgatggctgcatccatgctgctagagcttccaaacagccatggccggtgtgcaagaaacagaggattctctacctgctccagcactccttctcggaactttcggtttgcagccaccagctcctcatatgtgagacccagagactggaacatggcctctgtaagttttcgagagatgggggatatgggaacctcatcggggaaaactcgaggcagcacgtacttccacaaaatatcgtccatgtagagatcagacgagaggagaggctctgtgggcttgaaaccactctcagcgacatccgccagcttcttcttgttgtattgcatcttcttaatctccaagagaacccgtagctcggacatgtattcgttcatacccacaggcttgtgatcgtgagctccccaccaccatgtaacctttttgccttccttcagagccttgactcggtctgcacgagctcgctgggcccaggggtcgtatgtgaggtttctcgtgcgtgccaaatcaaatattgcggtgcagccgatgagtgctgatccagtgaggatgcctgtagccttgactgctctgtatggccactttccgtatttggccctgaaagttgatctccgcggataggctagcagcaagacgcccacacccatctgagcagcacatacaatggtaagtgcatatttgttatcggccgcgggtaccagtttgccccacatgcgcaggacaaatgagggctgctgatacttgggaaagaacccatcttggtctttgtcgtttgccattttctgtgtcacgtcaacttcctaatcaaatgcttttatgttgagtgtttgccacgttgtgttaaccgcccgttacttgttgtaaggcttttcgctcttcctctcggcgtaatgagtgaagatggcgtaaatcaagtcaaatcctcctgttctgcacgatatgtgatggaaatggcatgcatgactaaggggtcctaaccctacaactacagtaaagaaacacggagtttgatactgaaactatttcatccaacaggacacagctatcgtgcacagagcaacactacaggtagaaagaggttaccagcgaatatgttttcaatatatctcaaacggtggacgttacataaaatcaaggagcgtaatcatcaacggcatcatcacttgaagccacatgtataagtgtatgtactgtacttcagatttgtgcatgatcgccacgagcaatatctgagagcttataatataagtcaaaaaaggtgacgagggtggtatcgcgaaggtggcgaagacaccaagtgtgacagaccccggctaattgcggcagattgttattgagggcttttggctcaaacacgtcgaataattacaagtgccctatttggactccttcatatcgatactgcatttgtatgggcaggaggcgattatacagtgaactacagacgacaccataaatggagtaaccactgtagagatagtacgggcttggctatcgtaaccgtgtatcacaccctggatatattgttcttaaacattagcggcccattgcctaatatcaccggtgtcttacgactcagcagtcattcgtgattacaatacctgaaaggaggctgcctcctttgtcacagcttactaaatttgagtcaagcccttttccagaagcccatatgcatgacgacgcgtgtacgaacgcacaagtactatgttcattcgttgtctttggtgcacccggttatctgattgttaacattgatagcaacatcgcattgttgttcatgcctgagcattttatcaatctgaccaagtgcacgacttcattcgaagtcgtgcactttaattacgtcacggtcaattttgcgtgaataatgctccatcggttaactcctccactcagcgtaactgggttccgcactatctcttggttaggatcattaacacgaaacttcattcccctctaaaagtaatagcgacaacaggagcatgtattggtaatcgatctacttttatgtggggttagctcgcgccgtgcatatggcatgttggccatggcttcattgtggcttggggccgtctatgacgaacactatatattagtaggacctcgtctctaatgaggttacaacttcttatccgactctacaataccaagaaaaatggcccgcacacctgtctacttcattcctcatggaggccccaccttcatgtacgagaatcaccctggaggagataaaggagcctttgactatctcagacatcttggacgagatctgatccagaaacacaaggagaatcccgactctgtcaagggcgttattgttatgtcggcccactgggaaagtgcgaaccagcaggacgagaaccccaagggtaccggtaacaacgagtttcccaaggtcaatggtaagggtattcccgtgggaattgtgactgacaaaaacgacaactaccccaacctcgaatacgatttcttcaatttcccagcccacatgtatgaggagaagttctgggctaagggcaaccatgcctctgctgagaagatcgccaaacttattgataacacccctggctactatgcccaattgagaagtgacaagaagtgggatcatggcgtgtgggtcgcttccagagttatgtttgaagaagctggtgaggaaaaaggtgccctcaagttccccatcatcaatatttcagaacctgcaggtgacgacgtggaccatctgagtcctcgacagctgtctgagagattctacaacctcggcaaggcactcgcacctctgagagatgagggatattggataattggatccggtatgtcagttcacaatcttcgagaacgacgtaagtttgctgatggtggagagcccgagtattcccagccttttgaagatgctgtcaaggacgtggtagagaatgtcacgagtgtgcctgtttctgatgagcaaaatctggaaaacctttcagagctttggaagaaccctcaccgaccagctgcccatcccaccgctgaacatctctttcccttctacttctcagcaggagctgctgacggtgacaagggtgttcaggagtacacaaagatctcaggcagcactgcatggggtctattcaaatggggtggttccacaggagattattaaatgctgtttttagctgtgtctagcaataccatcatacccctcagtttgtggggaagatcctgaagaatgtgcgagcaagacatgtgattcgtagcgttcgagcatgggtggcttgtttatgccttggtaattttcacctttagagccgtatgaactatattgaatggcaaccgagaatacgatcgaagtgttcgttcaaggctgagcattcgtatgccatgttcatgtataactcgtgcgagatattgtggacggcccgttccgcataagtactgtcaatacatatcgaatcaaaaccaatgaaattttcagcctcttgcaaccgttgaaacattaggtgtccagctatctcatgaaccgacggttatcgggaatgaattccgtagagttccaggaaatttaacctgccagtttagcaccaacccttgaggtttatcaaaataggcgtttggaggagatccacttcttcttgaggtccgctggaacaatgagggcgtacgcaatgaaggtcccactgaattactcgggggaagcatgatcctctttgtttacagaaggaaccgttaactgccgaactcaatgcgtctcgatagcacgagtacatactacttgtagtactacttgtagcacttccggtacagacagaagtacgagtaattgtaactatacaaaaaacaaggggtaatcagagcctgcataggtccttagaggagttatttcatgagacgcatgcacctctctagtccttgaaagtcttaccagttcacttctaagcggtggtacgaggtgtctcgtcttggcatgtcttttcgaaatggtagcgtgcacatgaaggtcttcgatgccaccttgccgatgctaccatcatgtaggtttcctgtgaagcatgatctgacagccaatgatagcgggagattatgcctgttctggttgtctcgaagtgagacggttgtttgatgctcgctaatcttgcgtcattactgccatgctcggttagctaaaggaccttggaaaatcccgttcacacctcattcttcctggggctctgcaggtcctatcttgaagacaaattacctcaacattccgtaccagagtctggcgcagtaaagcttcctttaacttggtcggagtcagaaggtttcggtggagttggcagttgagagagagccacaattcatttagagtcttggctgcatcggagccagacttgatgtcagctcttggcctcttggcattgatgtgcatgtttccggtagacaaaaggcggtgggaaattgaatatttttccatttccaggagttagtatctacatcactcacctgattagttaatttaagcctttcttgctcgcagaataatggtgacttcactgataacgatatgaaccatgcttgatggcgactgaaccgtatcagaagttatctttctctcctccttcgggatattttcaagccactctatctaagctccatactggacaaagaccacgttatatatctaaggcagagatatcacaagtgctcgtatttatattggtttccttttgactgggctcagcaagaggtacagatcagctaactacagtatcattatttttgtggaggatgtcattctgcggtaaccgtggaacgagaacagggtggtgttaaaggaggccagcctcacgtaaacaaatccccacatcaaggaatgtcgcctttcctatgcatgtgtccttaagtcactggcaaactatagccgagaaagtccctgttacttgtactctactgtactgacgtcaagctcaagccttcgagctctaactgtcttcttgctttgctcgaaactctccttaaccgaatgaacctgggcacggcactgtggctgtcaagattttatgatacgataaggcccaaagaaactcacatgagaatatggggtatatataacagaagtgcgttctgcccattttatattatcattttcattctatcaccacccgtttctcaatgacttcacaccttggtgaccacctcgaggatcacctggagccatccagagatgacaatctctattatcatgaggaggaggaagctcccggttaccaggcatacacttctcaggcagattaccctgcgaagcctacctactctggaagtggttcatctcagcgacggttcgatgactataacacttctcttgagaagaaggaaggtgatatcgagttcaccgaagtcgttgatgagtctgaacactactcgcagaagtggtctacgtatactgacgagtataaccctgacgggctgcgggtcgcaacagatgaggagtgtatgactcttcgaaagatcgctgctccgatctctgccatgacttacatgctgtctctagtcgagtttgccgaacgaggttcctattatgggctaaccaacgtcatctccaactttgttcaattccctttgcctcccggaggaaacggctggggtgctacacccaaagactctcagtccaccgctggtgctctcaaccagggactccaggttgctactgctctcactcttgttctccaatttctgtcctacctcactccccttcttggtgcttaccttgcagattcaaagtacgggcgtttccccacaatttgggccggtaccatcgtttgtggagttggtcatgtcatcattgttatttccggtatccccggtgttcttgaacaccagaaggcctcattaggcgtgtttatcgctgggttgatcatctttgcttttggaacaggtctattcaagcctaatttgttgcctctccttctggaacagtaccgagaagatgataactgggtcaagaagctcaagagtggtgaggaggttgttatcgacaaagagtccaccctccagcgaatgaccctggtctactactggtccattaacgtcggaggattccttggtttgggtactgcctacgctgagaagcgaatcggctactggctcgcatttctggtccccactatcctctacttcttccttcccttcttcctctttattatccgaaaccgggtttataaggctccttctagcgaggactccatcatcgccggttttgtcggtgttatgtggcagtggctcttcagaaagccttctacttactcggagaagttcgtggctgatgtctggaccaccctcaaggctacccgtttcttccttttcttccccatctacttcatcaatgacaacggcattggagctctttccaactcacagggaagttcgatgatcacgaatggtgttccgaacgatctgctcaacaacttcaatcccatcaccattatcgtggcggtgcctatcgtcaactatatcctgtatcctctgctgcgtcgatacagaatcaacttccgcgcttcgtttcgaatcttcctgggtttcatgctggcagctttctctcccatgattggagccattctgcagtggcgaatctatgaaacttctccttgtggatactacgcaacagattgtgacaagggtgttgctcccatcaccatctggtggcaggtcttcccctatttctgcacagcgctatctgaaatctttgccgtcactacctcctacgagctggcctactcccttgcgcctgcccatctgcgatctattgtcctcgctctgctgctcttcatgtcggctttcagcaccgccattcagaccggtatcactccggcgctggttgatccccatctgatttggccgtttgtgggcatttcagtggcgggtgcagcctttgccattgcattcttgtgttgttactggcgtctcggaaagggccaggaggtttctgtctaaggaggatgttgcataagaaaagtatgagtacaagtaacgagatactgtaatagcattgggcccctatcgccccttataaaaaaagacagtaatagtccaaacaaaaaaaaaaaaaacaaaaaaaaaaaaaaagtctataactttcggcctattgaatcaataggaggaggccattacctgtcaaagctacagtatgtagtagtatccactaattcagcaataatcgtacgtaatactcgtgcttgcactgtagctaccccttatatgatcccctacctacaagtaccgatatactgtacgtcacggtaattatttgtagtttgggagcccaccaagaaataccaaatgtacgaccgcgacggtgcagggtatgtatgtgtatgcccactccaaaaggtagtcaaggaaagttcaaggccaaaaacgcgttcacgcccatgtcttacaataacaatgtgtttgcaaggtatcatacctggtctgcctcggcaagtcaaacgtaagcatacccgtccccctgtttggacgccgcactcccaatgcaggtactgccccctaagatgttgcattagcaggatgctaaattgtcgagagataattgtttagcccacaagtccgtcaaatcatgatatctcggattttccattaagtacgacgacggttgtgggggataatcagcatcatcgtgcggtgcataccaaagatctacaccgcaatcagacatagcctattgtctattaaacctagatcaggtgggcaccaacggtatgacggttaccatgtcaacgctatgcaagcataaggttcgaaggttgaaaataggctcggagggtaaactctcactagtcaagactttgcccctgaatgggtcatgagacaaaaggacatgctgacctgagtgccagattgaaagagaatctgctgtcttgtttctccccgcctgtgatagtttcaaaagagaccaaagaggccctgcatggcaaaaggaggcgcagcggtatgtgatcttcaggggaaggttgaaaccctgtcgacagatctgcaaagaggaatgagcgggaaaagtgacgcgctcaatgtttggtgctcagggtattggattgcagatctgcccagggcatattagacttggcagaaaagtcactacaagcacatattttagagacccaaatcattaggaagggagttattgttacaataaataaatgttcaggcgtgaagaaccttggtgcatgccaggtgtgtatggtagacgggtggaacggtctgtttaaacacgtcccatctctcgaacgctccatgagtggcgtgaagaagtgaatcgtttagactttgtctgcacaagagcagcacgttctttctggacgtcaacagcaattgaagcaggtcgcttcatcttcgtagttccctgggtcaggggtcgtcgtatagcctgctgctggtgcttctctcgatgagagaagcattcatcaattgtatcgaatttgtggccacaggtgatgcaaacgaccttatgtttcagaggagccttgcagaatatttcagcgtcgtcttcgtcatactcgtccagattgatggtgggatcgacataaggatcctccgtatcggagaataggtcatcggatccggatgaagcagatgattcctcttcttcgggctccttgatggcagtaggtcgctggaagaatggggcaacctgcagaacagatgctctcttggctgatctctctgggagaataggtgacagagacatcgatgctgggcgggtggttctggcggaggagaagctaggggatgaagagacaactgccagagaaaatcgcttagatggagggggtttgctaagaggagaaggggtagtgggcgggttggctgctatgatttctgccttgttagtggtggtgctggtgttgatgttggtgttggcgttggtgttggtgttggttttggtgttgatgttgttgttggtgttggtagatgagatcattgtttgtgttgtggcgggtcccgtgggagttgtagataggggcgatgggctcttggtgttcttggtgttcttggtgttcttggtttccttgggtttcttttcctctgagatatcgatcaatgatgagtaggaagcgttaccactaaagatccgtcgcgtattgtctgccgttttctggggctggtccttgcttcgtgacttgggtcgtgtaacttcttcattgacagtcttggctcggcccatggtcttgagactgcgttctgagttggaggagttggaagacatgaacgaagtgaatgaagagatgctggacttgcgtcttcccaggttccgctccctctcagtggatgtagctgtgtcgttaatggcaggctcgtcgaagttcaaggactctctggatctgttcttccatcgtgagagagtctgtgatagtgacagttttgacacgtgccgggtgtcgtcatgacgaagtgccattggtttgtcggagcaaatttgatggtacaagtacaagtatgttggagaaggggtcccggaaaggagctcctgtatatatatttagccttgtggagagagttggctaacactttgctaatacaaagcacaacccacgtttaattagagttgtttcggacagttcctcctggtgaatgaggccgaattgcttctaaagtgtctgtgtggtaggaattgagccggtgtttgccctccagacagcggttgagtatgaactgggtcctatatatgatatttctggtttgagactctgatccagcaaaatcaagggcaatctccagtgactatcatttcgtgatccgctcccgcgaaaggtaaaagcgaagtctaaacacacgccaatggcctgaaacgcaaagttgaaccgagtttgtgtgtctgtgggctccaaattcacaaaaaccaaaagaacaaagctgcaacgaccacaccaccacaacacgagcttgttttccaccggttacatctgcaaggtaaagagtcgtcactctcctcttttttctctctcaatacagcattactattaccttgtacaagtacgattctcgtactgtacagtgcgcggctcacggaaatggcacgtgatcaacaacagacgaaattgacactgccaacggccaagagccacggcacccagggatgaatcaggggtaggtgctacataaaagggattcaccctccaaaaagacccgtcacaatgtgctggagcatttttgttgccaatatcgcattatattatttggtggtacgagtctagagagtctaacaaggcagtgggaagcacttgttcgttaagcttgtacccccttcgtacgtgttcctgtaaatatagagagagaagatttgattagatatatagaatattgaataaatagcaaaacaccgtgggggcatccccgctgatgctgagcatttaaccccacttggatcaataaagccacactaacccatctgtcatttgcacagctatgttagtaatttgtcgtgatgatcagaagagctcttgtaagaggatcagtgtaactatgacattaccgcagcattgcacccaacagaagtcaaaacgacgactggttttgaggacgctcaattgttggtagattggtttatcatcattttagctggacactccatttccgatactcacttgttccagtgctgtgtgagagaacaagtttttcttcaacgtgagcttaaaaccatttttttcgccaatttacccggccgtcaagccctatgtgtaatctacgtgattgcgggttcgatttctgcatgtgttcgtaatcagataaagttgaggatcattagaggctgtcggcggtaatatcgacactgggtctcaaggtggctgtcgattgcagttgtagaatctgaaacacctcctctcgtttcaatctccatgaaatcacggcctcaaagtctgaatgaggctccagaagcgtcatcgatgcatccggaatgacacccggtttaggcagcccgatagagttgatgagactgaatctcgaattacaactacagcacaccatacaatacatgctgtaggtgctgtactctgtgcggtagacccgctttttgctgttagagcaagagtgtcgatattatctgattgacttttgttcggcgatgttatctctcgtgttatcatttgctttgcccatactgtaattgaggagcccgtattcagatgtcagtgggttacagtagttggtggttgatgccagtaagagatcacctttggattgagattgaccttcaagcaaacatccaattctacagtacgagtaagtcaccaatgacatcactgaacgtggcagtctcgatggcgtctgtttgtttgtacaggaagcactattgtggcggctgttgcaaccgcccgtttttgtctgagagtagtggattcggcctttttctcctccggtttcattttcactcgtcgatgtgtctttttcggcgatttcatggctcaaaagtgccgagaccttactgaactcgtggtacatacatactgtacatacagtatggggctcagtgagtgccaaaataagttgaatagctgctttgaaagcacaaatgttgtaatgggctgtttcagagctgtggcaattatctaaatatcacttgtccgatgcttgcacttgcactcgtacaggacggctcttggtgttaatatggcgtcccacatcagctgataacgcagggtgaggacaatgtcactgagacatggatgcttgatctgatacttcaatgtccccgacaaaattattggatgctcctgtatagagaaatatataaatacgagtacgagtacacacgatacccaagacatagacgacatcgagtggagagccaactcaatagtcgtttcagtctggcggggacatgagggacctctatcttctcaagaagtcacctgcccttatgctgtggggtcgtcaattctcggcattgcctgcatcctccagaagttgacccgcaacgctccgttagtcccttggcatagggatgagtcggaggagggcagacacaggagaacatttggaagcataagaatacgctggctctaggataatggcaatggcaatggcttgtgtacaagaacacataccattcttgccgagctctaatcaacgtgaccaaatatatttgtgccttccttttgtgcgtggccgctccggaataataccgtgctaccccgttgtgtcccgcaatatgcctcttcccagattggctgcaaccttgtcagcctttggacgtgtgagacgtaggaatttgacagccgcacatttgatatggggtaaacaaaggagaggaaactggggctgtagtaaaaagctggtagaagcatgtcccgtgacattccacacgtgtgtgtcttttccaatgcagttccaaccgctgttgatcgtcaaatataccacttcggaactcagccggaccctattataagcagtgtggcttccccactatagttaaaagtggcttaaaccagatgtggctatggggcggggaaaagttgcgctgacgtttgttgagggacgtctaattaaaagcacaagtagtagagatgagctaacagtaggccgctgagaatcactaaccaatcatgttgcttgcacctcatatgacaggttacaagcgtaacattggcacggtgtcaacaacaaacctatagcgatgtcacaggtcatagggaatcgtatgttgagccccaaaatgtaacgttttggtattagagtatcaggctagcagggtgaggacacgcagaggagtctaatatacatcacaaggttactacaaatacattgtggggtgtcattcagatcaggagtgccatctcaaatcatcccgcacttacaccaccactctcttctctctcgctcatcacactcactttccgtcattacatcattattcattacattaagtgaaatcaaagtgtttatcaatggagttatcactacggctaagcgtcttttcgagcgtgtctgaaatgtccacagcgttggcgttctggaacgcatgttcagacaaaaaccggagaatcatcaaccattccaaaaccgaaggggtcaaacagctgctcatggcaatgtgatagagccatctaacaacatttgaagagccccagataactgacgttgatgtcagtgttccaccaacgctccacatagtcatgcagaaacttctcgtcgtgcgagttgtacatctccagacctgtctgaagcacgtctgcgtgcgccagagttaaagtatggtggttttcgcgatatagatcccgtgtcaccagactctggaccgtcgcattcagccggttggttatttgctggaaatagccaaccaaaagcacctcgagagttagcgagtcatcgtcctcatcgtcaaactccaaaccctccagatactgttcgtcctcgatggtggagatttcgcctgccgaggccagccacagcatgttgtttgcaagcacctcgtaaaactgcctccatagaggtttcttggccgacgttggacacggttgactgtgatgtgcttgggataacagttgctggaacgcagggcctcttccctcttcacgtaccgctttaatgaaatgagttaaaacatgataccttctcgagtcgcgttgagaggggaaaccgtagttcgtaatctgcactccgtcattcgatagttggacagccacgtcgtggtcactctttctgtgtaacatgatagtgtcactggtgatggccaggtagttgttcatcttcgccagacgttcggaatcttgaactgtgacgttgtattgtaagttgagctccggtaatgtgtcgctggatgcccccaagagtcccagtatatataccagcgatgttgcctgttccagggttattccagtgtcgtggtccagcactatgagtagacggtttctgagtagcgtttgtcggtgaatctcaaaaaactcgggccctatcattgtcagcaacggtaccagagcatagatggggtgtcgttctggcgccattggcttgggcccttttgttagcagcgaccagagtccattgagcactttcacttcgtctcccttttctagagccttcatagttgtatccaagatattgaggtaattccagggctcgtcgacaagcactcccagcgcaaagacggtatttcttcgctcgccctcgttgttgccaatgtttctgtccaccacaactgccactcctggttgtccattgtgagagaggtagaccacatcgtcctgctgaaacgatgacggaatagccttgtactcgacgccgcctagcccttcgccaaatcctttgagtatcgaatggcccagcttcacgtcaaaagtggcatagaagagctgcattctgagtatcgcatgtatggagtcagtctctgggtggtatgtttaacttccgacaggcttaataaactatcgccgaacacgcaaatacggggtaagacgtgataccaatttgtaatattgtacgagaacacggaatatgttaatatatgacaaacagaggtggataccgggaattgcgtaaggtgatatggatgttaggtctttcttgccacagacaatatatactgacctacaaatgtactggtatctgtaccctcatgattgatgtcataaggtcacttaaaaaatagccaggagtaaacagtgtggttaaaatttataatatataaaaaatgaaaaaatacaagtaaaagaaaagcagcttttgcaccagcactgtaactccgatacaggaaatcgaaatctggtctccatggttctcgagtatgagagcgtggtatgagggatcgaaacgctgtttacgtaattgtatttgagtgcaagaaaaacccgaagaaaaaaagtgaaaacatatgaaataaaatggtactctactggacggggtagctactcgtacacccctgcacgccgtccaactactgtattacttaagttttatgctatataattacatctacttgaccagctcgttaacaaaagcggaaaagtactttttgaagtccttgttctccaaggtcttgagtttctcgacgtagtccttggcggcgttgtcgggcactccaatctgagggaagtactgctcgactaaatagctaaggaactggtctcccttcttcagatagatgtgcttctgaatgtttccaagctccgtcaccaaaatcttactctgggcgtcctgcagattgaaacccgacgaggcaggcacctgccagcacagtccagagaactccagcacaatctgctcgaagccgtcaatcttctggccttggtcaaacacgctctcctcggcagaagcagcttcaagctcaccgttgccccacagctgaatcatcttggtgagacaagaggcagcggatcgacaggtataaatgtcggtggggtcggaagcatagtggatgactgacttgatgatggagtcggccagttgcttgtcctcgacaatggctcctcccattcgatctcgtagaatctgcatgatgaacatgaggtatgcacgctggatctccaccttgagcaccttgtcgtcagtgtttccggcgtctgcggacgcagacagctcctcaagagaggcaaacacacgctggcagagtggagacagcagagatttaagcatgttgtagacaccctcgtcgtttcggaaggaatgcagcagatggccaaggaagcccaggaagtcggcaagctcggcatgagagcatctctgaagcaagatttggatgagagtggatatctcggagagaatggaggagcccagaatgggcaccagacgggtgaagaccgttcgcgcagcctcccggaccttggtatcagggattcggtcgagggctacattgaccacctcggcagagtttttgaagagctggagaatgccgtccggcagcttgttagaagatccatccaagccgtgggcgaaagtgccaatcgcaaccagattatggtggaccagagtgatggactcggcgttgggaggagacactccaatggccttctccacagcagtaaagataggttggagagtctgttcgactccgttggtggcagatgcctcgtcaagaatggaaacaaggataccagacagttcgaagaggttgagctgggcgttgaaggccgagccagcgctctcatcatcggagtcagtgtcgtcctcagtctggatgactagcaggggccggatggagtccaccagcagctgagcgacctggccaatctgaggcttgacagacttgcagaacttgtggaacaagatccaggaccgcatttgaacctttgtggactcggagttctggatgcccaaaggtgagacgaagaactccagcacgcggtttagaaggttggtgttgtgttgcgaaaagagcgaagaatgtttgacgacaatttccatgaacagcagatgcacggcgggctgggggcattgagccacggcgtcagaggcaaccatctggaagaacaggttgttgaaggcctgggtagcgggtgactcgttctgcccagtcttgacagtggatagagcgcccgatcgcatggcctcggacagggtctgaagctcaaacatacccagttcgatgtctctccaatcagcagtaggaggcagagagagagcctgggagatgacaggacagacgtcatcaaggaacagctggttgtcgatagatgcgcacatatcctgcaggtttttgagccgttgtcgcagttcgcagaactcgccatcctcatcctcctcccactcttggtcgtcaaggtatctgcacttcttcatgacagcctcaagaatagaccggaccacggcatggcgttggtcggaaatgaaggttctgtcagcagggaagttttcatactggtcggcggtgttttttgtgagtctgttggggttgattttggccttttctcgcttggagtctcgtctaaccagctgcaagtaggagcccacagagggtagaacctgggacgaggtgtcgtcgtactcgttgccgaggtaacgcagcaacagagggaacatgtccagaagcagagcctcacagtttgcgctgaactcttggctttctgtttcgacaatgtgaatgagttcggagccgatggagttggccagcttggcaacccgctcgtcgaactcaatgtctgcagactgcgatagagtgtgaatgatgctggtgaggttgagcgactggatgagctgaaacttcgcgttagggtacattttcttggcgacaatctcactgagacagtcgcaggcgtgaattcgggactttggagagctcagcaggttgaaaatagcctccagcgcctcgggctctgcaatgagggtcagctcggcccaagaaacccatcctccgattacgcgaagagcgttgttgacaatctcagtggccaggggctccagttgctggtccttgtagtacatgagaatctttttccaggagtctgccagacgggccatatctcggttccggatcagatccttgaggtcgttgttgcgcgactgaaccgcaggatctcgaataatcagcgtgtctccaatctctcggtggatatcgttcagtacgcgtaggtacagatccgccgcacgcgggttgccaaactggttctcggggctctccagtagccgctcaaagtcgtaaaagaaggtgtcccaaatttccgtgtaggtcataatgaacagataggccagggtttcacccagcttgttcttcatgtggactggatcatcagcaaagctgacggcctggccgacattgacgttggcctgtccctggctgagtccactgcccattctcacgtatgcaaaaaggtgatcacgcacatagacaagctgctcacggttgagccgacccagagcctcatcaatcacctgaagactaaagtatcgcgcagcatcacttcgcttccggtctccagcaaacatcgccaagcacatctgccaaccttcgtcagacgccttgacctggttgcagaaatccagggcctgctgtcgcacggccgggtcgccgacgccttggatcgcgatatctaccgcctgttcgatttggtcttccatttggttgatgttgtgaattttatgaaaaccacgtcttagttgcaaagctagatttgtttgaaaagttacccggaaaattacacactgtggcgagtcacgtgcagttggtggggcaaccataccaagtgggaaacctctctgcacgcgtggtgactattttcattttctctgtaagcaggagctcttcatatcacgccccatcaatttaatgaattttacgtgcaaaaatttccgccccgcaaaaagtaaggaccccttagttattacttgtactctattcttgacacccaactctgtacaagtatgaggttgttgacagtgtatttactatgtgttggactgtttgtgagtctgtctgtgcaggtctgtgccttagagaaaaaacaccaactctgtacgtaagcctatttctcttgggtgagaacctgtccacgtcttcaaactttgatagtatgtagtgcgcatcacgtgaatgacatgataagccgactcggcatgagtgcggaaatgacaccagcggggtatatatggcaatgacgatggtatttagctggtccgatcttgatcccacgttcgaccgaacatgtcccgatcgtcgccacctcttgaattacaccacatcccccaaaacattcttcacattcttgctcccgatactggatgttcctttgattaaacttcgggtcacctacaatcgcctcatcctctcaaccggacctccactttctacaccaaccacacatccctacatcaaaagacgtccaaacgcggttcttttgaagcacggaaaccagcaggacactcccctagcataactcgtcacgtgacaatcctttttatccgccctacatccagagttgcggctttatccagccacccaccacagccatcatgtaccgacccacaaccgctaccagactcagtgtggctccctgccgactcatcataagacacaagtcatccaagtcaccatctcccgcctccaacgtggctccccagcccgtgaagaagggcgaagaagacgaggtcaaggccgacgccaaacccgaggcagctaataaagctccacagcccaagaccgcctccacaactgctacatccacatccactacatccaccgctgcatcttcgcctgccccctcggcaccagctcctccatacgagaacaacccttacatgttcagtcgtagccacttcaccccaaacttctcgcgacaccagagtggcaacacttcgtcccccacccgcattctcggcatccagccacaccccttcaccgtcaaggaacacaccggagagtccatgaacgagattttcctccacaaggcgctcgcctcacacatgcagcctctgctgctgagcctggacgaccgaaagagagagatccccagcaaggtgtacaagttccgaaaccagcgacaggttcccaaggccgaaaattcgctgtggctcaagtctgtgctgcgacagcagacgcactcagacatggacctcattccccaggaaatgctccagcagatggtgcccttccggcctctcagtgacgttacccgaaagttttgggacgtcaagatgaaggttgacttcaagcggcagcagcagcggaagcaggagccagaagaagaggaggatgactcctactgaacgcttttttgagcgccgattttgtgtctcacttatattctagaatgaaccccgctatatcatactgggaacattagagtccagttcccactaactcatataacttattgatttattacgacgttttgtaccaactactctagtttcccgatgcatacttgttgacgtaatatcgaaccagaccttccatggcgctttcgtcgccacatcgcacgagattggctgcgtcaatgttaagaggcgaatctggttctggcagagatagcatggccgacactgcggtgcatgcagaagagatggtccatgctggggaccactgcgtcttgagaacgtcaatgcacacctctccggtttcaaagtggatgtttgggtggcagattttcgttcggaaaaacatggtcggtggctgtagcgggtagttttcggggatgttgatttccacctgccagagaccgttttcatatgcagtgccctcggttcctctcatgacggcagtccatttgtagagactatcgccgtcggctgtgagcgatgctaggcaaggattggggtctttcttgtatgctgccagctccttgatgagtcgtttctgggaggccattttcagagcgtatgattgtgcttgagtagatgttagggcgatggctagggcggcaagagcgagcttaagagacacaaatgtgacgcagaagacaaataacagaaatgcggcggtaacgagatagctcagagaggttgcgacgaaaaaccagacgttgacggtggagatccgaggtagagatttcatgcgatgcaagccataggtacagtaatatatcacatgcgtcagttgggaggagaaaagtgctgtgtcacgggggttggggtccaaccttacacgcactgtagcttaatatcaacggtcgtcctggggggcgttggagtaaggtttttaccttgcataaccacacagaataatcggcatcgcgatacttagacagcactacagtaccacttcaacacagcgcacaattttatcaacatgtcacactcacacccggtacggcgaattctgtcgcccaaagatctggaaatatttggcgccagtgacacaaaaaagcaagtgtttgggttcgtgaaggtgctcaactactatgtggtgggcaagggcaactcatacgagacgctgaagcacccaatcattggcaaattggtggccattctcgacaaggtgattgatcttgtcgccaagtatccgcctgaagatgctacgtcgtcacggttcggaaaacctgagttcagagatttccatcaggctctggaggagaacgccaaggactggatctcggatttgggagagttggaggactggcagctcgtggagctctgtacatatttcgctgcctcttttggtgaccgaacgcgaattgatttcggatctggccacgagctcaactttatctgtttcctcttctgtctgaggcagctgggtctgcttgatgtgccagagtacaatcctgaggtgcacgatccaacaggagaggccaagaatgccaagtgtgtggaagatgagactgattcctctgcagcagttttgacggtgtttgtccagtatcttaagaccatgcgtgctgttcaagcaagctattggctggagcctgcaggctctcatggtgtctggggtctcgatgactaccacttcctacccttcatgtttggatctgcccagcttgcatgccacaagtacctgcggccgttatccatccacgacatggagatgttggatatgtggaagcatgagtatctgtacatgggttgcatccacttcatcaacagtgtcaagaccactgcttctctgagatggcattcccccatgctggatgacatctccggagtcaagacctgggccaaggtgaaccagggtatggttaagatgtacgacgctgaggttctgagcaagctccccattctccagcatttcatgttcggtcagctgatcaaggctcctgagggggtgtcacctcctcctgatcccaatgctgaagtgcagcacattcacaaccattgggctgactgttgtggaatcaaggtgcccagtgccattgcagcctctgagatgagccagaaacctggagatctgcgcaaactgcgtggttccggtgttttgccttttgattaggcaatccccagcttccattggcacgaaattatacaatagataggcatataaactacgatacaatacaggatgaggtaatgattagatgatatggcgaataagcaaaataaatataggtgaccggggtagctagacctcagagggatctccgaggtagaagcactggaacgagaggctgtttacagtggacccaaccaaaacgccgtttctcttgtgccagacaatcttctttcgatcattctggcccacgggtaccgtgcagaattgaaaggtagacatgtctagcacacctctggagaagaccaggtgtttgccaaactgaacagggtgtacgtcggcaacgaacccatacttttcggggatcaagtaagccttgactgaatcagtagagcaatcgtagattattctccacgatgcgagcctaccctctttgaatatgaccaggttgtctccaaaagttagaatgcggtgatgccaccactgttttcctctcaaattgccattcttctgcgttcgagaaatatggctgactgacagaacaagcttataatgaggcaggggggaatttagagagctggtcaggaggtaaatgtagtgaacatcttccttgtatgactccaccaaaaagagattcgaagttggacttccagccagtgccagtgcgtacttctcgtttttctgaggtagaaatgtgtagaattgtgaagcgtaagacgcttctttcacgtagggctgaaagcaacgaatgatgcaaatctctgtgggtcctgagagagaagccttgtagctggtgctgaaaagagcagcaacgactctgttgctagatgcctcaccgaggtggaagtaattcgagcaaattctgacattccaccagtagctgggatcgcccacattcaagcagtctgtgtttggaatggtgcgcagagttgtgttagtcgatttgtccttcgacgcacgaggtgctggctggtggatccaaggagtcatggcgccggttatgggattgaagaaggcatgggtggacttgccagatatgacgtagccctcagtgatgggattcaccacagacccgggggtataaagctcctgcgacaccttgagagtctcctggaagtggctggaaaagttccgtgggtcgtactctgttgcactcttgggttcgaaaaacaagtcaacccaatcgaaacattgaggtgggtcgactgactgatcaacatctgtggaatcaccggtatcaccgaccatcatccatccgggaatgaacttctgagggacaatcttggtcgcgactttctcctcggtaatctccagagtggtatcatcttccgaggggggttgcgtggtctgtgtagtgtcggactcgtggacagcagcaaaggtagtctcccaagcctcgggagccaaaggaaagactacccgagatttctcaatggtttcaatgtcccattggaagtcagcaacaggaccgtcattgctgaagtcgacctcaaaggcggtgatgagaggattggcagcaacaggaacaggttcggtggacttgggtcgtagcgtggccttgctcttggccggtggcagggcctttttcttggaaatcttgaagctgtggtggattgccatcgcgtatgggtgtccggatgagtaaaatacatacattgtgattccaattatataaatattgagatgattgcaagacattggccctgtaacgggtgacaagctgataataaatatgaacaagtgcggttgaggcacacttctttgttctgcgccatacctgactgcagctgataaggacggattttttaccaagcaaaccgcagctgtgcagctgtgaatacggggggcttccacttgaggagctccgagttgacctttcggcgccgctttttgagcatcttttcatacttttcgcacacactgtctgtcaaacaaatgatgtgttggcccttgtagtacttgagcatgttgtatgtctgcagggtatgcagcacatctgtagtggtcatggcggtcacggaggcaatgtcttcgattgtcatctcctgcttacccttctccatgagcaactcaataatggtgtctgcccaataggctcggtatgacagcagacccagatctgaaagaggcttttctggggaaccagtcttgccctcagccttggaaagggcatatgagaagtcaataagaaggcggccataaccgtgacgctggtattgcggcagtgtgagaatacaagcgacattgtatccctcagcagactccttctccttggaaaagtatcctaccagatggtgacccttctcatctcgtcgagtcatgcagtagaaaaggaaggggtccacatcgtagtagagagtcttatgatccaggaaaagctttgaaaggagacacaggtttcggcaccatgttctctgctttctgccgtcaatctcgaagaaactgactgcctcatctcgatagatttcgttcccaggaggatgtctcagagtggatttggatctgaaccgctcaaactgcttcttggacccgaaataacacagggtaaagtcgcaaatgtagatttcatcttcttcggtcagctcgataggatagggagaaaagtaccacggttcgatgacatgattgcctagaacaattctctgtaaatttcgaactcgagccacctcatgactgctctgtgtcatacttcctccagttctgagcttctcaatctcctcgtcacggttgaaattgtcggggtcctgggtggtgccgttaacctggaggttgtccaggtccatgacatcttccgaattggctccaggagtagttgcagccgaatctgtgagcttctgcttcttggaggggttcttcttcttctccttgctgctctcctttgcagcaccactgagaggcttcttgggcttctctggctcgggccaaatgacaccctgtgacaagtcgactcgagtagccgcaatacgctcatccagacgcttgttgaactcgacgtagtgcacatagaactcgaggttaccacgtctcatttgcacgctgagaatttcagcaactcggtcctcaccgtctttctcgacgtggactttgcagcccacacggagctcgttgattgccacgttcatgtcgaccttctgaacgggcgcaggagtctcctcggaccccgaggctttgccgttggttttgccgttgggcaagtctgcttctgcgagagccatctttggaggtgttgtgagcgacagtaaactgcctgggtgttatatagcttcgtcgcgctattgctcgttgatgttcgggtggcgacaaaattttgataaactgaaaatagttatggtcacgtgatgttgggagatgagtacagccaccttaatagagacaggaatgtgccagttactgtaggggggaatttacgaaatatcgtcttgttatatgatattattcagttattaaatctgcgattatattggtgaaacacacatatatccaactgtacaagtacaatgtacatgtagttgttatttcatttttatttggagaccatccatttttatgtttccggaaaaaaatgaaaattgtataagtatggttctggaattgggtccatatactgtgcctgtattggtaccactggcctacaagtagagcgaaggctgaaaaggagggaaagcaaaacaaaagaatgacaacgccaaccaatacaattgtacttgtaactaaaaatacattaaatatgcgaaattctgatacaccatccctctaataggtctggtatatcttgggtttccattcgagaccgggatcactttctgctgtggcattgggcttctcgcgccacattttgatgctcttgtcagcctcacaggtgatgaggcgaagaccagtcttgtcgaaactggagtcgaaaataccgttttcactctcgatagatcctgggatgggaatagactgggtgctctggaacatatgtccagtcttccagtcataaaagccaatagagccgttgtcgcctcccgaaaacatgacgttgtcttggttaacggacagggtattgatgatagcgttctggtcgtcgtagttgagcactagatcgccctcgggacacttccattgcttactggagttagcagaggccgtggagaaagtgaactcctcgggatgtaaagtgaggcctcgcacactcttcttgtgatgcgtgagcgttgtcatggtcttcccggcctgtaggttccacagtcgcacagtctcatctgccgaagctgtaatcacctggggttcagaggcctggaacttgactctgttgatagtcgacttgtgtccactgagaacaaccacagggtcacgagtacgaatgtcccacacacgggccacagcgtctcgaccagcagacactaggacatccagagtaggatgaatgtccagcgagtagactgcagagagatggccatggtagtgtcgaacgaccttgttagtttccagatcccaacacttgaccatcttgtcttcacctcccgaaaacatgtaaggatgtcgtggcgacactcccaatgctctaacacccataatgtgtcctgtgagagtcagtcgcaattttcctgtagccagatcccagatcttgatagtcttgtctgcagaacctgtagcaaaccactggttctctggttcaacacaaacagatctcacccagccctgatggcctgtaatgactctgtagatctcccatggtgcgtgccacgccggtttcgactgtgtaaggttggctccgagattagtgagactgtcgtgtgtagttggttggcttgcagagggcgtgtgtttcgtgagtgccgaggaagaagctcccatcagagccttctggccgctctgagatcctcctgcgattcgctggactgccacacctcctgtggcttccactgccaaacccttctctgccattttggcagccacctgctttgctaggtatggtggaagttcgaggttctggaactccctgagtttttgagcacgtcggatatttcgagagggttcattttcgccggtcgcgagagtaccatactctggaaacaggtctttggcgacaggcatgtgtggattacaagttccttgtagtctctgattatgacggctgaaatgttcatgcaagttattcagatagccttgtacaggttatgagtggtgtgagcaggggaacaagttggaaactggataaacgaaatatgattggccagattcaactctgcttcaaaaatgaaacaattcttctttcacactccagatattactccccctgagcctcgttttcggttactgtaaccctcccctaattatcgttgtgctcttgaactgggaggcgtccacataaacttttacaccatttcctctttctccccaccgcaaccatgtccaacagattattgggagtccttacaagtgagtattgaaaggctggaaagggaagatgagtccatacataagttcaatgtgccattgcgaatatcctgacaccaaacaatggcatgtttgccaacttggcgtgggggtgccgcaccgcacatccacagcaacacgcaatctcgagaccccatactaacccagccatcgccattcctgtcggtgttggcatcaccttgatgcagtccgccatgtacgacgttcgtggtggctaccgagctgtcatcttcgaccgtcttgccggtgtcaagcagaacgtgatcggagagggaacccacttcctcgttccctggctccagaaggacattatcttcgatgtccgaaccaagccccgaaacatcgccaccaccaccggatccaaggatctgcagatggtttctctgaccctgcgagttctgcaccgacccgtcatttcccagcttccccacatctaccagtctcttggtctcgactacgacgagcgagtcctgccctccattggtaacgaggtgctcaagtctattgtcgctcaattcgatgccgccgagctcattacccagcgagaggttgtttccgcccgaattcgagaggatcttgtcaagcgagccggtgagttcaacattgccctcgaggatgtctccattacccacatgaccttcggaaaggagttcaccaaggccgttgagcagaagcaaattgcccagcaggatgccgagcgagcccgattcatcgtcgagaaggccgagcaggagcgacaagccgccgttatccgagctgagggagaagccgagtccgccgaggccatttccaaggctcttgagaaggccggtgatggtctgctcttgattcgacgaatcgaggcctccaaggagattgccaccactcttgcccagtccaacaacgtcacttacctgcccaagggaggcaacggatccaatggcgcttcctctggcaactctcttcttctcaacgtcggaagataattgtatatagatattttgtaactaaacttgacacactgaatgataggttttgatgatttcgatgcaagtacaagtagcgccactggtactcgtagtgtagcgatagcgtgtccagatgttggttataatatttgtggtcgtggaacaccagactttatgaagtgcattcgtaccataaagctacaactatgaaagaatattaataataattgggagcctgacaaaagagtccctttgcaatataggaatattgactctacgatactcctgtctcttgtaccgtttgttgtgttgtccacattgtccaccccagctgcttcactcactcacaccatgaaagttcgaaaatgcaggacaggaataattatttctgggtgtcgtctgggagtctgacacaacaccatacgtcatgttatcggtatatgctgaccagcaccgggaggcgccgttcccgaaaaaggcatacaaagctgagcttcaaaaaactacggaaaacgcaggactaggcctacaggtgtccgaattcctgagcgaggctgagatcatccactcgctctattaccggtaccgaaatgcccaccattgcgccgaatggttcaggcctttctcgatgttacatcgacgggtatcccaggttgcaaactggattgttgacttgcacaaagccaccaagaagcgtgctcctcgactgatcactgctatcaagatatcgatccagaagatccagaccaggtacctccagcctgccttttggagcttctacagcgtcctggctctaggacaatacgtcacagttggatttgcattgctaggaaccgtggcaaggattgccagccttttagcacaagttcacccgatacccaggacagtaggaaaggtactcgatgcagctgttaaaaagggagctgaggtcatgtccgatgatatcggtgaggttctagttagggtcacatctgagaagcctgcaaaatctgacaagatcaagaagatgaccaaaagcacagttactaagactaccacgggaggaaagaagctgcttaagaacatggacatcgacgatatcttctcgaccaagaagaagaccaagaaaaacatagagaagcctagggttgttgaagagaatgttgaagaaagtattatcacaaatgatgatattgaggataattctatgctgactgagccagcgccgaaggccaagaaggtcaaggtggccaaggtggaaaacttctttgaggaatccaaggacaagaagaagaagaatcctgcttctctagacgatagtctggagcctccgaagaagaagaagaagatactggattcaacagacggcatgaagaaaaagaagaaaaagtctaagaagaatgccatcgacgatatctttggctaaccgcatacccatatttaatcattgcatttattaacactgtacacactgcatctggcgtaggtgacccttgagaagtatcaggctcatattgtattgtaacatttttttttacaagtgttgtgtgtatcattgtggttctcattgtatgcacttcattaaattactgattcatcgaactatttacatggaacctacagagaggttccctccaaaaaatgctttgcccagttgggcagcacaaatgatgcctcgtggatttccttgttatagtatctgaccagactggactcttcctcttgagtccactgtcgcttggggatcttgagattggtcggcttcttactgcagaccatcagacccagctggccagaggtgtaagtgggcaacagagcagcgcagtattccacagatgcgaaaacacccttgcagatgtcacggagttgcttgacaaacttgaagttgagccagacgttctccgaagactgggtgataacaataccgtcatcattgagggcggtgtgcaaaagctgaaaatactcgcgctggaagaacttttcagcagggccatcggggtccgaagagtcagtgatgatgacgtcgtacttctcatcactccgggcaacttctcggatgaactcgaaaccgtctctgatatgaactgtgaccttggtgttatcgaaacctacggccatgttggggagatacttcttggagagctcgatgacgctctcgtcaatctcacacaaatgtgcagcctccacagactcatgcttaacgatttctctgagaactccaccatctccgcctccaataaccagcactctcttgggacactcatgcgacatcatggctacatggcaaatcatctcctggtacgcaaactcatctcgctcagacacctgtaccactccatccagaaccagcacatttccgtactccgtggatcgaaacacaagaacatcctggaactcgctctgcgaaacatgcaaaatttcctcgaccttcagcatcaggccctggcctggaaaagagtcggaaacttcagtgaaccaagagtctgtgttagtattgatcagatgcgcaaccagagagcctacggtggtttctgacactcattcagccgtggtacttcactctgagtcaggtctgatctgtaggcctcatcttgaggcacttcggtattgcgcccacgaaccccctccaacgcaaatactcactcttaatactggcgtgttctagttgcttgaccgtcatgatttctgcgtgcaaggaaccgtcaggagtctcagaatggggatatagaaaataatttaggtccagaaaagagtgcagtgaagttgcatgaaaactcaactgtatatccatgaggcatgttccaggcaggtcaacccgccatgtccaccttgtgagaggataacagagcctttctgatatttttgatagagaaagcacttaagttagaataatgatccggcaacgatctctttgtactcgcacgaacaatttttacatccagtcctggacacatcttccatacaagatttttctctcggcaattttttgcgccgcactaaaagtcagatagagatgataacaattagagttgccacgtgaccaaaaggggtgatttttgatcctgacaattactcatcttgctcattagaaccagcccttgtaccatttttccgtcgtcctaacacctgtggctcactaatgtggtgctatttccaatcccaagtcggattacgtaattcatgcaggatgccaaaatttatctgaatcttaatcggaatgatttattcacacaactgaggccctaacgagtgttcaaagtcgcccaatgaagcatccttatcacatcgtgtctctttctcctgacggaaagaccatgtacgccgctgctgcgcgacaggtggatcgaatctgcctcgagaccggcgagtgcaagtccactgtcgttgaggagtctgccactcgaacaaccaccaaaaccggagataagcctgctgctgccaaacgaaccaagtacctgcctacgtctgtgtctcatgtcagatctctgcaactttccaagggcggaaagtatctgctggccaccacagacgagaccaagtctcttgttctgcttgatcccacaacccttgaagtgatcaagaaggtgcaataccccaagagacccagcgctgtcgctactgacaaggaggatctgaacattgttcttggcgacaagttcggagacgtgtacggagagtctgtggaggatctgctcaaggtggagggagaactcaaagacgagcctgtgctgggccatgtctccatgctcacagctctggagctgggctacgactccaaggatcgaccttacgtcatttctgccgaccgagacgagcacattcgaatcagtcggttccccgcttcccacgtcattgagcagttctgctttggccaccagcagtttgtctccagcctgttgatcaacgatctcgatgcctccattctcttctctgccggtggagatgacgagatctttgtgtgggactggctcaatggcaagcagctgcagaagctgtctctgcgagagcacgtcgagagctaccttaacgaggcccacatttatgtcgacaagaagggcgttgctaccacccacaaggagatcacagtgtcttctctgcagcagatcaaggacactccttacctgctcgtcaacgtcgagagcaccaacgctattattgtgctcaagattgtcgacaacaagctggaggttgcctctgtcttcgccactgaggctcatgtcatttctttcagcgtggctggcaacctcctggtgacctctgaagttggctctgagggagtcaaggcatacaccatcaccgacggagtcgtgaccaagagtgacaaggagattccctttggctcttgcgagtacgaggacgattccgagctcatttctctcttcagcaccaagtcgttgcgaaagcgaggagagttctaagtggtttgtttcttgacggggttctaacaatggagggaggtgttacttgcaaagagtagccagcatatgtacaacaatgcctcgaggaggtttaaaagtaactattgaatacatgatagatttttattgattgaacagacgtatcctagtgtacttgtgacagaccacacacttggagggctggccccatcaactaatttctcctctatttttagtttaagttcacaaggttggattttttttcggggagtgtctcaggtggcttcagcgcatactgtatcgagagaagaacacccacgtcacgtttcgtttcgtggttaggttgcccagctaaatgaaaaataggccgatcatcatccttccacgtgatatctgagctgtgtaggagctcaagttgactgtttttttttttgcttttgccaccccagaacgaatacgaatacctaaatacacgtgccctcagcgcaagtggactcaccacatcgtcgtgggctacagttcaagggcaccatctacggctctctccacacgtcgttcttttttccttagccttttttgcagtgcgcgtgtcccaaaccccagctctacacaccagcacaaacaaagttaagctcagggttgtcgttgaggtcgcttactgtagtcagtgctcgtatggttcgttcaattttcgccaaaaatcgttttgcctttgtatcttgggaataacatcaactgtggttcttcaacaggcctaaggaacgaaacaagccggaccaagatcaggttcaaggtgagtactgagaaggaatagaaggcctaaaggcgcaaaccgacaggtggcaacagctccacaccgaccacgaaggccacgaaatcaaggggtcctaaagttagtctttgtggcctcgacggtcagcgaaaacgcgagaccacaacgcgatcagaaccaggacctaaacaacacaggacggggtcacaataggcttgaacagcaagtacaagctgtgatctctctatatttgattctcaaaccacccctgactacttcagcgcctctgtgacacagcccccctatcatccgactaacacagatgctacaagcagctattggaaagattgtgggatttgcggtcaaccgacccatccacacagttgtcctgacgtccatcgtggcgtcaaccgcatacctcgccatcctcgacattgccatcccgggtttcgagggcacacaacccatctcatactaccaccctgcagcaaaatcttacgacaaccctgctgattggacccacattgcagaggccgacatcccttcagacgcctaccgacttgcatttgcccagatccgtgtcagtgatgttcagggcggagaggcccccaccatccctggcgccgtggccgtgtctgatctcgaccacagaatcgtcatggactacaaacagtgggccccctggaccgccagcaacgagcagatcgcctcggagaaccacatctggaagcactccttcaaggaccacgtggccttcagctggatcaagtggttccgatgggcctacctgcgtttgtccactctcatccagggggcagacaacttcgacattgccgtggtcgcccttggctatcttgccatgcactacaccttcttcagtctcttccgatccatgcgaaaggttggctcgcacttttggcttgcctccatggctctggtctcttccaccttcgctttcctgcttgcggtggtggcttcctctagcctgggttaccgacctagcatgatcaccatgtccgagggcctgcccttcctcgtggtcgccattggctttgaccgaaaggtcaacctggctagcgaggtgctcacatccaagagcagccagctcgctcccatggtgcaggtgatcacaaagatcgcctccaaggcgctgtttgagtacagccttgaggtggccgccctgtttgctggcgcctataccggagttcctcgactgtcccagttttgcttcttatctgcttggatcctcatcttcgactacatgtttttgctgaccttctactctgctgtccttgctatcaagtttgagatcaatcacattaagcgaaaccgaatgatccaggatgctctcaaggaggatggtgtatctgctgctgttgccgagaaggtagccgactcttctcccgacgccaagctcgaccgaaagtccgacgtttctctttttggagcctctggcgccattgcggtgttcaagatcttcatggtccttgggttccttggtctcaacctcatcaacctgactgccatccctcaccttggcaaggcggccgccgctgcccagtctgtgactcccatcaccctctcccccgagcttctccatgccatccccgcctctgtgcccgttgttgtcacctttgtgcccagcgttgtgtacgagcactcccagctcattctgcagctggaggacgccctcactaccttcctggctgcctgctccaaaactattggtgaccccgtcatctccaagtacatcttcctgtgcctgatggtctccaccgccctgaacgtctacctgtttggagccacccgagaagttgtgcgaacccagtctgtgaaggtggttgagaagcacgttcctatcgtcattgagaagcccagcgagaaggaggaggacacctcttctgaagactccattgagctgactgtcggaaagcagcccaagcccgtgaccgagacccgttctctggacgacctagaggctatcatgaaggcaggtaagaccaagcttctggaggaccacgaggttgtcaagctctctctcgagggcaagcttcctttgtatgctcttgagaagcagcttggtgacaacacccgagctgttggcatccgacgatctatcatctcccagcagtctaataccaagactttagagacctcaaagcttccttacctgcactacgactacgaccgtgtttttggagcctgttgcgagaacgttattggttacatgcctctccccgttggtgttgctggccccatgaacattgatggcaagaactaccacattcctatggccaccactgagggttgtcttgttgcctcaaccatgcgaggttgcaaggccatcaacgccggtggcggtgttaccactgtgcttactcaggacggtatgacacgaggtccttgtgtttccttcccctctctcaagcgggctggagccgctaagatctggcttgattccgaggagggtctcaagtccatgcgaaaggccttcaactccacctctcgatttgctcgtctccagtctcttcactctacccttgctggtaacctgctgtttattcgattccgaaccaccactggtgatgccatgggcatgaacatgatctccaagggcgtcgaacactctctggccgtcatggtcaaggagtacggcttccctgatatggacattgtgtctgtctcgggtaactactgcactgacaagaagcccgcagcgatcaactggatcgaaggccgaggcaagagtgttgttgccgaagccaccatccctgctcacattgtcaagtctgttctcaaaagtgaggttgacgctcttgttgagctcaacatcagcaagaatctgatcggtagtgccatggctggctctgtgggaggtttcaatgcacacgccgcaaacctggtgaccgccatctaccttgccactggccaggatcctgctcagaatgtcgagtcttccaactgcatcacgctgatgagcaacgtcgacggtaacctgctcatctccgtttccatgccttctatcgaggtcggtaccattggtggaggtactattttggagccccagggggctatgctggagatgcttggcgtgcgaggtcctcacatcgagacccccggtgccaacgcccaacagcttgctcgcatcattgcttctggagttcttgcagcggagctttcgctgtgttctgctcttgctgccggccatcttgtgcaaagtcatatgacccacaaccggtcccaggctcctactccggccaagcagtctcaggccgatctgcagcgtctacaaaacggttcgaatatttgcatacggtcataggtgtacaatagtgaaggaaacagagttaataaatatatacaattagtgtacgtacatctggtagaacaatgtgttggcataattagggacggtatgaactgagtcctgccaacctgatgctaactaatgtgtggttgtaattggactgggtcgattttcgagaaataaaccaataaacgaacacgttgttcctagcccctttaaagagacagtgcaagtactgtacatactgtacttagaagcatactggtatgtactgtatgtactgtacatgcttcatctggctggatcaaagacgatgatcaatacacagggacccaacgggaatagaaatcacataggtgtacaagtattttataataacaagtaaccaaagaagctgtcttagttggtcggttctagtactccagattggtatgtcccctatgtaatacttacgtcgattttaataaagttcatgcacaccaccatctaacatctcagccaagtttactccacaccattatcattacacacgcagcacttctggtatggcatctctagcaacatttcaggtggagaacgacattgtggacgtcgacagcacgccccaacaaggatttgatcgagacgacctgtacaagtacgacgatgttgaacaaaaggcgatccttgcagcccatccatggagaacagatccctcgtactttcggaacgtgctggtgtcttcaattgcattggtgaagatggcgatgcatgctcgatcaggtggtgctattgaggtcatgggaatgatgactggaaagatcttgcccaacacatttgttgtcatggactgctatcctcttccagtggagggtacagagacaagggtcaatgcccagcaggagggtatcgagttcatggtggagtatctgcagggcctcaaggacgtgggacgccgagaaaacattgtcggatggtaccattcgcatcccggctacggttgttggctcagtggtattgacgtggacacacagtttcagaaccagcagttccaggaaccgttcctggcggtggtggtggaccccaaccgaaccatctcagctggaaaggtcgagatcggtgctttccgaacctatcccaaggattacaagccccccaagaaggctactaaacaaaaccaggaccagagcgtgcctttatccaaggccaaggactacggagcgcactctgagcgatactacgagctggacgtgtcatttttcaagtcctcgctggatgaaaacctgctgcaattactctggaacaaaaactgggccgccaccttatctcagtcgactattcagctaaaccacgactacacatccaagctgatgcttgatctgagtgagaagaatgcacagctagcgatcgggctcggcgagaaaactccccagtctcagggtcgaggtttccgagaggctatgtcaaaggctgacaacgagcctcacactaacctgctcaactacagcacaaagggccagtgggaggctgtgaaccggtctgtaaaggatggagttcagatcgggtccgacgagctgcagggtctcatgtctcttgagatccagagacggctgtttggtcgagcgaagtaggaggtatagcatatttaatttaacgaattcatcaatacaaggagggacagaagtgacagcacgacgacatacattttatcttagcaaggagtcactgtagatattagtcactgtatactacagtatgtacagtagattctggttcaactgtggtacatgctggtgcaaaaatgtgatacaaatgctcaattaccacaacttttctcaccaacttacacgagttatgtccacatactcgtaggtgctacaatacagcatcgatcgaatacaaatactacccagaacactggaaaccgtgttcaactacatgaggagttgattttatgtggttatattatttataaaaaaaaaaaaaaaaaaaaacctgacgaatcaagactcttagttgaggggctccatggagatctcaacgtactgagggttgacacaggaagcggcagcagcctcaacagcagtgggccggagctcccacatgccgttctggacctgacaggcaatgaagccctggttctggtaggtgagtcggttatctcggtaagaaaagccggtcagaccgtttcggacctggtttcggtcagtgaatcgcatggaagcctggttgccgagctggatgaatcgtccctggttatcaacgagctggccacggtaagagagctggccctggaactggttcaagttgccgtggcttcggttgtcgacaagcatgagacggccgtcattctggacgattcgggagtcccggaattgctggttgttggcaattcggagctgggagtcctggtatcgagcaagaccgttctgtcgggcaccgttcagagaaacggtgacgggcttcgagcaaggagctcgaccagcatacacctggtggaggtggtcggaagaccgctggttgtcagaaatatcgtaggcattgccgtactgatcaacggggcaggcctggaactgctgctggtcgttgtatctccaagagacacggttatcaccaaatcgctggatgttgatgttgttgtttcgtcgggtagacaaggcgagccggccgttgtcaacgccgacgtatcgagcggaggcgtcgggaccagcaatgttcagatcaccggcgatatcgatgaaaacattgacctctcgaagaggagaaccattgatgtctcgggcgtcaccaaagtagaggtttcggccgtcggttcgcatggcaatgttgcgattgtctcgctgagcagccatgtggtagacgtagtcagactggggccattggtacagagattggtcaataccggcaagggagtatcgaccgttgtcggtgtactgctcaccctgttcggcaagagccagggaggcaacgagggcgagggcggaggtggaaaacttcattgttaaaaggtgttgttgatagaatcgaatgggctgatagctagagaatgagtagggatatggaggggtttatatagtaacgcaagttgtagaggtcctacaattgtagaagtcataggatccctaaacataccttacaagacaagttgagagaacaaggaatccgtcagaccttacaacctgaacgtgatgttcccccaatcttgatcttttggtctttccctttttgccagaggaagttagaaatccgtgaaagtgtgagaggagtaagagtcgcggtgtagtctctctgtaaaacaaaaaataaaaataaaaaaactagatacaagagtgtagagcttcatcattcgagataccactcaactttgagctgctccagcaccaaccacagctatcaatcttcgcacgtagagtaaagacagaatcatgctgcttctggtaattgaaatgttgtgtgggttattattcaactgtccaaatcgggcaggtcggctttaacacatctaatggtgggggtaagcaagtcattaaatcatccaacggtttaagtggcttgtgtaaagtatttcgaagaacataccgtaccgatccaatagtacgacttaatggtacgacaccaataaacaaacatatttgcaccatttaatagacacttcttctgttgcgttgttacaagaccacaattgaaatctattcttagatcagaagatattgttgagatgcttgctacctatactgacagccgatatccagcactactcaccgcttattgagattcttcctcattaggaaactcccacaacttgagactacagtcaaccggcctatcttcctcccccgcgcgctcgccagaactggtagccacaacacctattcccgtcagtgggttggaagcgacagcagacacaggagaagagtgagctttccaagacgactcacacaagcgatcaatgcccatatctatatcctcccatgtgttgacatgaccgtccacagttcctgccaccagtccgcgtcctgtgattgtcttatcagcccacagtctctggctagtcttaccatcccagcctcctagggtagcgacgtgtcggagacccatgcggacgtccagaacaggtatttcaatggctcctctgcaaatcaaatgcaaataattctcgttgggcgaccacaatgtttgacaaataccctgggcggtaggtgcagagctggttttggcaacttcccccatagtgtcaaagtcgtagagagctagacttcccgaaaacgaggagacagcgacctgcttggatgcatgcgaaatgtgtgacaccaggccgaaactgggcatgtcccattggtattcgggttctgagccgacgttgttgacattaaagagtgccagacgacgttctgaacctgcgaataggtagtctgaaccaggtctaaaggcaacactcgatggagtgaggaattgttcgttgctcatgtcggtccacttgtagcatcccacagattgacttccacccagaacgttcgtaatctgaatcggcattcccctttggctcactaccgcaaagcaggaagagtaatctgccagttggaagccgggaaagacggaaaaggaaacaattggactcgagaaaaacgttcgcgtgtacggatacagattgtggggctgcttttctttgttggacagcagatcagggggaacaacaaacagtctcagggcatgatcttcattattggtgattaacgacgagccgtctggagtccacactgtctgcttgaacacgtcagctgagcgcttgcctgtccaggtctttgctcgattggcagaaccagccacgcgagtctccagttccatgccttgaaacatgtttgctaattgaatatcttcattaaccagagactcagaaatgctgtgggtatatgtggatcctgtgtctgcgaccaggtttggtatttctaatgatggaatcatttttgagaggcgtgtgggtgcgagtgcttgcaattgtgcaagcaacatgttgactcatggccaaactctgatccaaacatactggcaaaaaaaatccaaaaatgagaggacgacaggactcgaacccgcagcctttggaggacgtcgttcagaagaaccgaaatccaatgcgctaccattacgccacgtcctcaccaatttgatggaaaaatacagtttacagtggttaactcgcgtttgcttacataatcacctgacacaccgtaatgattcagaagtgtatgatttattgaacgccaataaccaggcttactacaatatatactgtagctgtaaagaatcattagaattaagaattatgtatttccttagaaaacatacatttccttataaaaaataaaaaataaaaaataaaaagctatagatgatttcaatagccattatattaatgaaatgtttctctatactcctgattcttcataggaatgatcattgtccagatagtacacttttcttttatctgttaccataatacagtgtacagtacaccttggaatgcttatatcattattttactgtctgtagtccaagcatgcggtacgtgaacgatcaacagcagtagctagaggagttggtgttgttggctctgtcctgagtgcttctgtcttcaagtgcacttccttggatacagtgtacactacaacctcttgagcaacagtgtcatatttacattatttacatatatcttgcacagagtatcggaccgcaattaacagctacagttgtctacccatctggggaatgctgtcacatctctgatgttctcaatacctgtagcgtagctgatgagtcgctcaaaacccatgccgaagcctccatgaggagtagatccctgctttcgaagctcaaggtaccactcaagagcactcttgtccatgcctgtagtctcgatgttcttcagcagagtgtcatagttatcttctcgaacggaacctccaataacttctccgatgtggggcataaggagatcgaaacaggcgacagtctgcgaatcgtgagggctctgcttcatgtagaagggcttctgctccttggggtagtcagttacaaacacaggcgaaatgaaatactctgttgccagccacttctcatgttcacttcggaggccaacctcatagtcgggtcggtgggcgaaaggctccttaaggtgctgcaggttaagaattttgatcgcttgcttgtatgtgagtctggggaagtcgcagttagccatgtcccatcgatcgagaagctcttccttctgttcagcgcttctccgagcatccaaaagatcgtttcgcgccttgttaccttcttccataagaggagcaagacatgacttcaccattccctcagcgaggtccatgagaggctccaggtcgtcaatgaacgagatctcggcttctgccatccagaactcgctcagatgacgattggtatcgctgttttcagcacggaaagcaggtgtgaaggtccacactcgacctacggcagctgccagaacttccagatgcaattgggtggaaacagtgaggtatgcgggcttgtctccgaagaacttgtctcctttgccccctccagccaccttgaacacctcaccggcaccctcacaatcagaagaggtcagcaggggagggttagtctgcacaaagtcgttctcggcgaagaagttggtcatttgagccatacagaatgatctgtatctaagagtagaggagttgacagaagttctccatctgagagcaggcagggttcgcagaaactcttgtttgtggaacttcttttgaatagggtattcgtccactgttccagtaaccttgaccgactcggcctggagttccagaccctgcttcttgccctgagaactgaccaagttgcccttgacagacacacatgcacccgtagtgagatcggaggtcacctgatcgggttggagcacagccataacaccctgggcacaattgccgtcggaaatgttgagaaatgcgacattcttgagcttctgtacagacttgatccaaccgttgatggtcacaggtgaagcatcctgagtgccgagaatgtgcttgttttcagtcttgatctggttgattgtctggggcagagtggtgatggatcggaccgtagaggattcgaacacccgctgggtcatcaaacgagttctggctattcgcagcatgtttcgatattgagtatttgaatgcccttctcaagaatccatcatattgacatgcagactcttgaaccttattctggattggaatatttatgtgaagtaatgcaacaaaaattgggggactaaaacgagtaatatctgttctcgtcgatttattttggtatatttttatttcctaccaacctgtatcaccctatagtagcgttcagatactgtcgaacagttgctggattacttacttttaaagagccagatttcaactgttgatcatttttagttgaatatataattgagccgttggctaccagtacacactgtagccgtgaaaatttctcccacactttttatacagtactactgaacaagtaatatagacttaccttaccttatctactgtactcgtgctatggatagcgggatatcttgacaaaataccatctgaactatcagagaacaagatgagctcccagagtgtacagtacatacgtaatacgcgtagtgttgtgttggaggaagaaccattgctgtattctacactgaatgttttagatcattgttgaaagcggccctcaacttgaccccaatttccactcatatgagacttcaatgtgtggatcacaaacaatacaatactgtacatacacgtatgtactggtacggtaacacaccaagatgaagtgtcactatgatatttgtcagcctgctccgaatccacttggtccaatgtggatccagcaacgctgatcactgacacaataaggctgaatagctaaatgagtccgtgttagaccctggagctttctggggctctgggctctatcttagcccgactcttgttgccaatagaattacagtagtagcaatccagggcagtctcgcacggggaagaactgcctaagtatgtactgtactgttttgggctgtcataatgtgaatcttccctcgtcagtattgtatgattagcaagatgcgccttctacgaggtcagagaatcgaatacaaatgattgataggcatatataattgttttttcggagttgacttctgttagtgtatcaggataaataatgacactcagtgtaaattacagagcactgtcatgattcggcaatttactactgtaagtcatacatagtcccaagaagtcagctcagcttctggatatatacaccactcttccctatataaacctgctccttctgtattacagtgcccacctcattaaacctactgctgtgtatttataatggaaatcacacaaccaagttatacacaatctatagtacgataaaaacgagtactcgtacttgtacgagttcaggtttaacttttgaaagtcaggattagtgagcaaggctggagcaaggtaagttcctggcttggggaatggtacaagaacatgctgtgcacacagtttcctagcgtgggcggctagaaaattgtttatattggtactggactactggtgcctccattgaccctacttgaagtagtgtgtactaatagtgcctaagtggctatgttaagacaggacatattctcctcccaccccaccctttgcacgtacattatccaagtatattacagaaccctgtgtggcagaaagaaccaccatctttatcctgcacccccaaatgcacgtgacacatatactgggctaaaatttgtctgtagcactattcaactcacccctgccgctgttattatctcctcttttcccgctcatctcccctctttaccccttccctctacgccccatgacgttgtctgtcagctgccatgcaacgttaatccttatcttacatccatcttgtgctagcttcttgtgaagttggggggtatattttaccaacatatttacgactcagaggaaagctcagaatatacacaataacaaccagagtcacagcaactactttttcacctgacatacatctgacacgtcagactacaaaccacaccttttgagagagaccatacacaccagtccacatcaagcaaccactgtataaaccccaccacgaccacaaaacatcttttacacctcaaacaacttcttgccactctcatataacatcacagcatgtctctcgaagaatcctggatcgacgtggaccaaaaggtcaccgtcaagcctcctgcccgctactcggcccgaatgcccaatgtggaggccttggaaacagagtcctcagccctcttctaccacgccccaagtgtctacatcatcgaaagcgatgcagaagaggatgacgagtacaactgcgactcccgtgatgaaaccacagacgacagaaccctgctcttttcccgggactctagaaactccccttcctccagagactctaccaccacaaccacatccatagctgctctacaggactcgttgtcgaccatcgtatcccgcgacatgaaacaggctcgtgcatgtggctcttcacgttcaaagccaccttcttctgtttgtctggactcgctgaggatcgtacctgagtcccagctacccaaaatgcgagctcgaggttccggaactgtggcacccgccatgtctagcacagactcggatagcgacacaaagatggcagtgaaaaaaaggcgtgtcaagcgagttagaacgggtgtctcttctccttccatggaggtttcaggtgctggaagtcctggcggcacgggtggcttttcccccgctgccttggcagccggcatcaccatcattggtttgtcgttctcagccggctatgccattggccgacagtcactgcgtacggcttccgtaaactgagatagcgctagaccacttgggccatcacggatgatatttatatggaatttactatcatggcgttgggtatttatataagttaataataatgagttgagcagtgaatctttccagtaatatcgtaattactgcttatcgtacaaggctggtatatgtatatgaaaaagagtaaataaaatacctaccataggtcgaggcggtgaggtatagtagaaacttgaacggtatttatagcaaagttcatgttttggagttttttaggacgctgcgtcattctttagtttagttagatcgccactccctcagtcctcttatacttgtacctactaaacatgcatgtaaaacgcacaacagttcatcaacaccagatcaccacaacaagcagacacagaagcgtgtcgacaacgacagaaacaacacagaaacaacacagaaacaacagaaacaacacgtgcgcgtaattcaacacatagacacgtccacatgcagatacaagcattcgactccattttcggagacgcttttgacgactctctgagaatacctgctgagacagacgttcaggacctaaacatggcttctctggacactatcagggagtggatgagtcctgacaatagcaacgctgatgttagtgatatccaggcgtcgatagcactcattcctctgatcgagtctgatctcctcaactggtaccacgaggtggtacgagtgcacttcctggagaatgtggccactcagttggatttcagtaatcttgattcactggagaagcttgagtcaattgcacttcgtcttgaagcagcccgtttccactaccacagacctttggagagtctatcattaagtcgtcatctggttgagaacttccaacattatttatttgcattattcgagatcacctttggaggaacgccgtatctcacggcacttaggaactacatggtttcctgttcgctgccacctacagaccgcaccatcaacctgtgcaagacactatataatctcggtctgggtcccaaactggagcccattctgtccagcagtttggtagctggcatcgagcgacatattctgaacgtttatggtgacgagtggaccctttcgtgtcttcccaccatgacagtgtggctcaaatcgtgtcttcctcgcattgaacaaatgtttctgcatccccctactctcgacagcttagtgtgtgtaggacaccgatacgtggctcggctgcgtacttcacagctatttgacatcactgtggactatcctgacagcatagctgcgatccaggaccttcgacagtgtctagagtctccccaccaacgagcacaggtagttgcaaccttccaaaacgcatgccagactcgacttttgcatgccggtgctaacacagtcgacgtgctctctgcatacattcatactacacacacatttttgctacttgattccaagggggtcttgttggagaaggtcacccgacccatcaagagatacctcaaggagcgctcagatactgtcacttccattgtgtctggtctactgggtaacgaaaaatcggatatcaagtccctggctgagtatctgtcaaaaccgcccagcactgttctcgaggatgatctggctgaccctcattgggtccctgatcctccggatgctccatcggacttccgaaagggcttcgccgacattgtagacgatcttatcatgctgtttgacaatcgcgaggtgtttgtgcgagagtttgttggtatctttgccgaccagatgttgcagctaagagactacaatgtgggagagattcagctacgtgctgagctactcaaacgtcgattcggtgagcgaactctgcagaatctagatgtgatggtccgagatatccaggagtctaagcgtgtggatacaggtgttcacgcagaatccatccagggcaaggctgtctatggtactttccacgcttctattctgtccaaactctgttggccgcagttgaagagtgaggaatttctacttccgtcagccattgagtctcagctgagtctctacggtacaggattctcaaagctcaaacagcgtcgaaagctcaagtggctgcgctctttgggtaacgtggacgtggagctggagttggaagatcgaaccgtggctttaactgttgctccagagatggcttcttttatccacgcgttccacgacaccaccgagaactcccttgagtatgtccaggagaaactcaagatgagtcccgagatggcacgtcgatgtgcagccttttgggtcaaggagggggtattgcaggagaagtcggaaggagtgttccgtgtgttggagcgcaagtcagaggcccagaatgttgtggttgctgacgcgtttgaggcttctgaggctggccagtctgccgaagacaaggccattgaatcgattcgacaatactggtcttacattcatgccatgctgacaaacagaggttcactgcctgtcatacagatgcattcgttcctcaaaatgctggtgccaaaggaaacgccgtacactgctactcaagatgagctcaagcagtttctgcaagccatggtggatgaagagaagttggatgtcgttggagccaaattcaagctgaagaagtagaaatagagaagtatggagatgaacctgtgaggttgtagtatcgtttggactcttgtaaaggggatgggaatacagttatggaataagaggctgtagttaggccaatgttggatcaactagctattaaatacaaaagccattgatatactacgaaatactctcaactaccattaatactgttaatgtattacagtttgtctgagttattaccagactaagactagctgggctggactgtttaaggcttgcatctgccagtgaatcgagggtacagggagcactctcgaacagtgaaccggtcacaaagccatgcgagaattcgctcagtacccaggccgtagcctccgtgagggaaagttccgtactttcgaagatcaatgaagaagtcgtaaggagcggtatcgatgccctctcgcttgaagccggccataagctcgtcgaggtcgtcgatacgcatagaacctccggtgatctctccgacgttgggcatgagaacatcgacggactcggtgactcggggatcgtcaacgcacttcttcatgtagaaggacttgatctccagggggaatcgggtgaggaagatgggcttgccgatctcgtcggtcatctttcgctcagcagcctcagcaatatcgtcgccaaaggtgaacttgttgccctcctcgttagggatgttgtgctcgttgagccactccagagcatcaacgtagggcattcgcatgaaaggtcgctcaggggccttgaaaccggggttgagctcctggacaaggggaccggcaacagggtcagcgagaacgtagtccacagttcggcacagcacctcctcgatgtgctccaggaatgtctcgaagtcaaggaagccaagctcggcctcaatgtgggtgtactcagacaaatgtcgtcgagtgtgggatcgctcggctcggaaagactcggcgatacagtaagcgtctccaaccgaagggatgacagtctccaggtacagctgggaggactgggtcaggtaggccttctccccgtagtagtcgagtgcgaaaagagtggaacctccctcaacctgggtttggaccatgcaaggaggtgtgatctcggtcattccgagctcgtcgtagactcgtcggatagaccgcaggaaagaggctcgcactttcatgacggcagacagagtctctcctcgcacagtcaggtatcggtagtcaagcaggtaagaggggtcagcgccctcctggaccttgttggtaatggcgtcgtcgccggaaggagcaagaccgatgatctcgtagaaatcaacgaccagctcgtgtccaccaggagctcgagcaccctcaggaacctccttgagggtaccgtagatggcaacagatgactcgagagtcaggttctgggtctggaaagcgttggcaagatctccctgaagaacacactgcaggtatccagtaccgtctcgcagaactaagaaagcaacacccttctgggttcgcagtcgatggacccagccaaacagcttgactcggggacctcggttctcggtggtgtctctgatcttgatcagcttgggtttgtccagagacttgtcctcggtgatagtgatcttcttggcagcctccagacgagcagcctcggcagcctctcgatcagccttggaagcctccagctgcttggccttctcagccttcttaactagaccgtcaacacccttcttggctttcttcagagcagagggggaaatgtcctcgtaagcgccctcagcaccctcagctccggccttgaagaccttgatctgagcatcagggtgagagtacagagcaaaagcgggagtcttgtagggagaatcctgagctccagaggcagaagactcgtcgacacccttagtatcgttgacgtaaattgcgggtccagacacagacagttgttcgacctttttttcgagatcagccatggtgatagttgcaagtgcagaatcagactcgaaattttcagacgaactttgactcatgtcgtgagcctgccctaaccctgtggctggggactaatgtgtgtcccaatttagggtgaattatcggtcattacgagcagatgaataaataaatgtgttcgttgcagctatatctgttggtttcattcttcaatcttttcttaatgactattaatggctgttttaattaccacaatcctcccattcaaagtagtaagagacctgcatacatcataacgttgatgtgatgagagaagtcccaactcaacatcgtgtaaataagatgttggtgttatctcggccttcctttctcgagctgactgacatgtgagtcatgaggaccgggtatcatttgagtggcgagtgtttgtgattggcttttgtccatattgggtgcgtacaaagctacttgtaggcggttgtgttacgggattgtgcgtaccaggctccataaatctaaaaccattagttgaatccatgtcaactaaagatccgaaattgcacaccaactaaggtagcattaatgcggagatggttatctgtgactcgaatggctcgtagaagacattattgaagagagagatgcattaaaaagttttctgatgaacaggcaatcaactccacaaacttatccacagtacttgactctgtttcatctcgcgtaagtacttgtacataccgaatcccagaatataaggaaccatctccaacattaggctgcgttagctattgactaatgaaatgaatatttcggacaaacatcagaaattggacacatttagaagagtgctactaatgcacttccattcaaacaagtacacgaagcattgatattaggattatataatcgctcgaccgattacattcgtacacacccatacccacaagctttatggtcacgtgcctctcatcgcgttggcctgccttataggtgtgtgtttcacgcaactctactgaaacgtgatggtcacaaccccttcaaccctaagtattgctgttgatgttagacagatggagagtaaacgagtggcgaagatgtgaatggtgttatggaggaggacccacgtgacactttgtgactctatactgcatcgttattcttgtcattcaatcctatctgacacattccttctaccctacaagtaggtgcttatccctggtcaaccttcggaccccgtcgcacctgataagcgacgggtttttgagataagaatcttgacaacggaacctgtcgttgagaagtacatcgctactgctactgtaatacaaaggatatttacccctggaataatatcgtattcatagtgggcatgtactgtatacaattggacaacacgtccacgtagttgagctaccgtgtatatccgaaggcactaacacaacccattattattaaacagctcgtgagcggggcttaggatgagcacctagggtggcgcgtactactgtagtttaggatgcttagtgacacacacgacctgacccttttagaggtacagtactatactcgtacaatagttacgaccaaagggctcgcccactgtttggctctcccttttatgtttaagatagcagcacgcctcgtagcacctggtcagtgtctctgataacaataatagagttgcgttgacacgcagtttgtgtgaccagagaaggatacatttcccaattgggactgctagcaaatgcggccaagggattacggtgaggagaagggtgttcatggatcgaaggatgggggaaatggggagattattggactgggtgacacgtgtaacctccatcctaaggcgcctccacggccttaaacccactcttcactcttccgtctccacttagacttcgccgttgaacgctaatgagtcactaccaagaccatgacaggcaagagggtaggtgaggccacaggctctgagattgcatggttggggggtcatgccgtgaagggctggagtagtagacaccgtgagtgtttagacaagtgtcacgtgataacactacacgtccacacgtaaatatagatccccataccggcccctccattgtgtctctctcgcagacaccttccttttacaacccaactttggagtaacgaccgactcacgttttttttcctcccaatccaactttgtaaggcacacgctcaaaatctcaaatctgaaattttgatttcacgaacttcatctggatatcatatttgaaagtgagtacactgaaaacactgacaaaacaagaccaacacgagtgaaatgacgcgaaaaacaaacgacgcaactaacaaagtgccccccaaagctgccaaggccaagaacgacaacatgttgatcggtatcaccgtcaacaaggaggacgacttctccggatggtaccagcagattgtcaccaagggagaaatgctggactactatgacgtgtccggctgctacatcatgcgacctccctcctactttgtgtgggagcagatccaggagtggttcaacatcaagatcaagaagctgggtgtcaagaacgcctacttccccatgtttgtgtcttctcgagtgctggagaaggagaaggaccacgtggagggttttgctcccgaggttgcctgggttaccaaggccggatcttcggatctcgaggagcctgtggctattcgacccacttccgagactgtcatgtacccctactacgccaagtgggtgcgatctcaccgagacttgcctctcaagctcaaccagtggaactccgttgtgcgatgggaattcaagcacccccagcctttcctgcgaacccgagagttcctgtggcaggagggccacaccgcccatctgactgccaaggaggccgaggatgaggtcatggctattctcgacaattacgagaagatctacagcgagctgctggctgtccccgtcattaagggtaagaagtccgagaaggagaagttcgcaggtgctctgttcaccaccaccgtcgagggctttattccttccactggtcgaggtatccagggagccacctcccattgtctgggccagaacttctccaagatgttcgacatctctgttgaggatcccaacggaggtgcagacaagctgtttgcctggcagaactcctggggtctgtctacccgagtcattggtgtcatgaccatgacccactccgacaacaagggtcttgtgctgccccctcgagtggcccacacccaggccatcatcatcccctgtggcctgaccgccaagcttgccgctgagaagcgagctgctgttatggacgcctccgctgccattgagaaggctctgtccgaggccgatgtccgagtcgcctccgatacccgagatacctactctccgggctggaagttttccgacgctgagctgcgaggtatccccctccgaatcgaggtcggtcctcgagatgttgagcagggaaagattgtggctgtgcgacgagacaacggcgagaagattgtgatggatattgccgacctggccacctctgtccccgagctgctggagaccatccagaaggacctcttctccaaggcaaaggagaccttcgataagcatgtcatcaaggccacaacctgggacgactttgtcaaggccctcaacgccggtaacctggttctggccccctggtccgcctccatcgagaccgaggagtggatcaaggacaactctgcccgaaccgtcgaccccaacaatgaggccgacgacaaggctccctccatgggcgccaagaccctgtgcattccttttgagcagcccgagcttgctgccgacgctgtctgcgtcactggctctggtaagaaggctgacaactggtgtttgtttggtcgatcttactaattgtcgggtgcaaaccacgaggttagtagagatgctaagctgtttaatcttgcagtgagatgagacaggctctgcagtctcgctgcgagtgatagattgatcttatcttaacatgtgggatgatgtctaccgcatggatgtaaaatgtatggtataggtaatgatgatggttttaaatagactgtgtggtgcgtgatgtatgatgatgtcatgatgctagtgaagttgctggtattacgtaggcagaattcatgattcaatggcgaattgcagtggttatacagctgctgtgacctaagagacctgtaagatgctggctatagtacgataccggtgcaagtactcatactaatactcgtacttagaagacttgcttccattgtttgctccaagcatatatactcattataaacgtgaggcagatgcatgaggtaatccatatgaagtatgatatgttctgccaacattatgtacggatatactgtttatacatatatgaatagctccgccttgtcgagctacgagtagtactatatccccatccttcctacgcggcatttccctctacatttccaacacttctacgagccaagtttgagtacaagtacacgtacagtatcggatccatggtcagtgattatttatatacattatcttgaatctacagtaggtctagtgtttagggaaagggcatacatgatatgtgggttggtggatcacattactcgatccacgctcactcggtatgtagcagtaactacggtaccgcaccactcagcccatgcgtattgtttagtaacacccactttcgctgagaaatacagctgactttctaacaggagacccagaaaccagcctccttggctctcacaatctcaatcttttgagcctccaccttgccactcttcttagtcaagaaccacagatccttgactcccaggccctccagatattcgagagttttcttatagttgagtcccacttgggctactccgtgactatcgtctgacagacacagtcgtcctcctcggttaataacagctttgcaaatgtcaggccggggatagggagtattccaaccctttcgaagaggagcagaagacacctcaatgaaacctccataggagatgatgaaatcgatgttcttgatgatctggtcccaaacatctggccagttctctcgcacgtagttctcggtggctccaaagccttctctaatggtggagtacagtcgaatgagatcaaaatgagcaaccacctcgggcttaagtttctgtagcatgttccattggatctcgtagtactttttgtagagagcatgttcaggagtagtctggtcgtcaatcatatcggacacagagtcagaagcatcgcaccattggccctggctgaaatcaataggaatgccgttgacgtggtgcacagatccaacacacaggtcaagaccatagtgcttcttgagctcaaccgctcgatcccagcactcggctcggatagactcacactcaaagcccaccagaatctctgtgttggaagtgttatccttctgtagctgtcgagcatgtttcacataatcgtcaaagaccttagcgagatcaacaggagtagttttggactcaatctcctcaggatacagatcggtctccctggatcgaggcatatgttctgtgagacagaaaacgtcgaatttcttgtccttggctgcctggacacattcttcaagactatccttagcgtgttggacgtactgtcccgagtgcgagtggtgagagtgcatgttggtggttgagaagaatgtcaatcactgcttgtcgaggcaccactgtggttatcgtgagatgcatgcaattaggcttttgatagtgacaacgggaaaaaaagacttgtgtagctaaccgaaggtcatatgggtcataggcgaggatttcgaacaatgtagctccaggaatcacttcttgaagactggaggagcgtaaaagatcgtttccgtgcgcattcgcatcatgagggtgttttaaagagtgctgttgtgccttcaatagccgccagtagtcataagcaaatacaagaatcggattccaatcaattattttaatacttacagccatgtcgttacaatgcatttttattacctataaatatgttgatttgatgctgttttttttgaggcggttcacagtgagtcaagaagagactgttggtgtatcttgtcgagcattctttaatgcactgaatgctggcaactggggcgtatgtgctgtagtagagcacatcctttctttacagccgagcagacctttcataactcgacagtgtatgggttctactcctccgctccaacaggctcgggaatgtctgtgaaggagaccttgtgggtgacaatctcaatgagatctacctgatgccggttttcggggtccattttgagcagccccagaggcttgtcgagcttctttatcgatcctcgcattcgctgtttcccgtcaatcaccagagtggcttttttctcttcaaattcaatggatccaacgcgtcttgatccctcctgcaaatgtgccttactgaccacttctccctggatttccacaatggccattcccgatggggtctggatcatctgaggcacggattccacatggtcgttttgtcgtaagtggtccagaaatatgttggtcacgttcatgtcaatggttgtcaagtacacagtgagtggatctcttaatttagcacgcactgtagacgcgcatttgagtttgggtgtggagaagggagaagagctctaaaaaaggtagagagagatggttaggtgaataaagggagtggctgacgagatgggtgtaagcgtaatctttgtataagactgtttactatataccgagtgaatttttgcttcagaatctcattgtatcacccctttagtggctctcaacctcgtctactttttcgaacctctgaatatgcatgtcccagcgcaactctacgtgggataaatatcatctccaccaaaacagtcattatccacctcaacccagccatcataatgacgtctctggccaacctgatatacgcacagactctctacaagtacgcgatcgacaacagcgtcaaatcggtagtcgtgttaccagatatcccccaacctatcgccgagtacatggcaacacaagttcccaaacacccattgattcaacccgacattctcagcatgacaggaggcccttcctcgctaactgccgcccattgtcaaaagtggtggcgtcagatgatctcatcgacgaaaattgcagaaaaggaactcgctctgagcagtttggccaagttggtggatggattcagacatgttttgtacaacgagacggtggctggtctgaaagccgacgaggtgaaattcaagcatctgaaggagatggagcgggataaaaagattaaggccgaaactgagcgattagagaaggaaagactagagaaggagagactacaaaaggaacaacaggaaaaagaacaacaggccagacgggaggcactagaagctagcaaagagcaggaagaggcctcaaaagctcagcaatcaatgacgaaatctgacgacgaggacgtagagatgactgacgctgtggaggaattgaaggagaacgaaaacagcagtaagaaggagcaggctgaagttgagactacagaggctgatgtggagtcagtaaaggtcaaggaggaagaaaaggacactgaggtcgagaccgaaaagaagacagtagaggctgaggctgaggctgaggctgaggctgaggctgaggctgaggctgaagagcagaattacaaggatgaagaggagcaggctgatggtgcagaggcagatgtcgagtcggacgcgagggaggctgaggagtcggggtccgacaaggaaacgactgccgacgtggagaccgaccgtggagagacagaagaacccgatgagagcgaattagaccgggtgacggaaactccagaggcaggagctactcctggatccgaggaacggactcgaaagcgagcacgatctaccactgaagactctgattcgcgaaagcggtcgcgccgaaacacctctgctgccccttcggccaaccgcaagtttcagaacgtggctggcaatctgctctcgaacatctcatccaacaaatctgcgtctttcttcacacaccctgtcaatcccaacagtgcgcccaactactacgagttgatcttttcgccgacggacatccggaccatcaaggcccaggtcaaggacggacgtatttcatccacttctgagcttgaacgtgaggtcgccaagatgtttgccaacgccatcatgtacaacccttgggactctgatgtaaacctgtgggctcgagagatgcagcaggagactgatgctctcttgaccttgtttcggggagcaggtggggagtagaacataattacgattgataatgattacaaatgtataacaccatgtttgcagttgcaactaaagtggtgcagctatgagtggcacagtccagtatgatcagactccgggcagatgatgatagtgatgcagaataaatacaatatcaaagtacaacaagggcaacatcaaacacaatcattggggttgcaccgcctcatctagtaactcgaacagggatcaattaatatgtacattttatctcttctgcataagagcagcgttctgttcctggaatctctggccgactcgttcagagtgcttgaggaacttctcggagcacttctcgagacaagactcttctcgggaagacagagccttggaggtgaagtcgttgacacagtcagtgaagcatcgctggacgagagaggagtagagctgggttagtatgtgtggtgtggtgttgtgttctgttctgttgtcgtggttgtcatcaagaaatttggaatactcactcgcatgaaatccttcatctgcttctgctcgacgagctgctggaactcctgctgttctcggttgttcaattgatccatcttgtgttgtgatttgggtgactgatgtgtgtgattgtcttgagcaacaacgaatacttttcactcccaggtggaaaagggtatcacgtgtcgagtttattttccagagaggggcgagtgtgattgggctgaaatatggcgttcaaaggcttttcagagtcccgtgagcatataatatcattgtgcactgttgaaataactacatcttctcattcttctgatatttcgccctcaatgaaccgctgcactcctattgccactcatcaccaaatctcggtatgaaccttgtagagttcggagaagctgggagaatcacggcttcaagaagtctcataaacacgcaatttgagcggtattgaaaatctaacattttagttggactcatcttatcgcaagtaccgaccaaaaaacttgaaattctcgattttgcgcgccgaaacatcatgttcaacgcaccttcttatgcactctttatcacggtgatatagttgttcagtatttctacaagtacaagttctggtaaaaacctataaccttacccaactccatcacacccagtgaagaaatatgcctcactgaatcctcaaacaaaacaccttgaccagcgaatatgtggaatgtccatctttagaatacacaaacacactcgtacaagtaccgtaccagccacatacttcaaatacacttctctatcacaatattcccttgcttaaacacattgctacaagggttaaaccacagggtgccatcttacagtatatgtatcgtacagtggttaagattagtttatctccggatcatcagagttaatcatacccatagatacagctgcggaaaggcgattgttatacagcatggcacattattacaagaaccgtgtacatccacactaaatccatcacacccactactcatcaataattcgttcaatgtcataatatcatctaaatcatacataattactggagcttgttgataacagccatggtgaactcgtcagtagtggagttgccgccaagatcgggggttcggacctggccctcagcaagaacgtcgtaggtagccttggagatgacgtcagcgaagtcatcgaggttgaggtgtcgcagaagcatggcggaagacagaatcatggcggtggggttagcggtacctcggcccttaatgtcaagaccgacgtgtcggcaaccgggctcgaaaacggcgtgctcggtacccaggttgacaccagggacgagaccggggcctccaacaagaccggcaccaatgttagacagaatggttccgtaaaggttaggggtgacgagaacgtcaaactgctggggccaagagacggcctgcatggaggcgttgtcgacaatcatgtcgccgtactggatctcggggtactcggcggagacctccttacaggtgtttcggaacagaccatcggcaagcttcataatgttggccttgtggatggcagtgaccttgtgtcggttgttcttgagagcaaagtcaaaggcaaatcgggcaattcgctcggactttcgcttggtgatgaccttgatggactcaacaacaccggggacaggggagtgctccagaccggagtactcaccctcagtgttctctcggatcagagccatgtcaatgccgtcgagtcgggtctggacaccggggatgttcttgatgagaacgagagaagcaaaaatgtcgagctctcgtcgcagggcaacgttgaaagaagtgtgaccgtgcttctcaacgggggtgtggaggatacccttgatggcaaccttgtttcggttgatggatcgaatggcctcctcgtagccgtcgagatggttctcgccaacaccggtgacattgacaacctcccagtcaatggggacggagatagtcttgaagatggtcttgacagcgtcagtaatctcgttaccgataccatcaccggggatgagggtgacggtgtacttggatccgtactccttgggctggaacatggttcgagcgttggtagcgagggttcgcttggggagagccgaggcggcctgggttagtatgttatcctaatgttttggtgtcgatgatagttattgtggtgtgcggcaattaacacaaaacacaccagcaacagcagcggcgtgcgacaacaacgtaaacaggtgtcttcgtatccgcatcgcctcaattgttctccattcccctgtccccacacagtgtgctactgcccgctactatttttctccgtagcacatgcaggaaaaaaaatagtggagggaaaataaatacacgcatagatgttccgggggtggtggtgacgtggacaggaccaaagtaggagactgtggagcaatcggcgccggagttgcgacatacactagccattggtctcaatggcgtcttcccctgccccgagtctctgtctgtgatgctgttgttgtttccgagaaaatgttatgggttgtacacagatgtcgtcggtcatgtagcgcgcatcgctgtgccatggagcggtgcttccattgcaccttgagtcacctccattgactcgcccggagtactcaccttagccaggtaggcggttcgaagcattgtggatgtggatatgttttcgattagacgacaagatgttgccaaaaggtgtcctagttaaagaagagagagagagagagttttatgtgggaggatgcaaaaaaagcttttacgaaattaaggacggcgaggtttaaacacggcgtcagagcgaaacctctatttcgaaggagacaagcttgaagaagagagctgcgccaggggcattaaaaagagtgtctggcacgtcacactgggctcgtggcgagccattcgatattcctaggccatatactacttggaaaactttttcctgcggctccatctgtaccctgtcagctgcaccatactccgccaaaaaatttacattgttacattcatttacatgtacacgtttctcccacatatctccatgcaaatcggaaaaacaacatccgtccgggtacccgaccatagaggcttttatccgcttagctccgagcaggggggatatgaatgggggcttaaggggtgtcgaaataatcggtggaggtcgaccggaacgttcaaattgactaacgatgccaattgagacgtccaacggtgtctcatactcacggttgctccaataaccgcgttcttttgtctcgtcatacttgcacccttggctcctctctttgctcccatccagctttgacttcttctttgacttcgaagtctgcgtgtgtgcagtgcccattggccaaaagtaggaaaaaccttgcaccgaaacacgatccggagcgacccggataatggatattagtgggagtttggggagccggtgaactagctttgatcttgggaacaacgtctgcgctagcggatatggttagcacatttccacaattctaagtgtcgatgacgcagatgagaatcgaacgcgcacacagaatccaaaccttaaacaaaaaccacgggtacaacagcccaaattgaactcgcgatatcagggcagaatcaaactacaagtagcactatcaaaatcgtgatcctgatcagatcaacggcatcaacaatatgtcgaagtccctaaacctttacagatcgctctatcgagagctgtcaaagcagtatgtcgctgcaatgaccgtccacatcaacggtgagaaccagcgaaacgaagccaaggcgaagtacgaggcgatccagaagaaaactacacccaaggccattgagaagctgcccacaccccgaacttcacattacaacagtactgctctcagagagtacttcacaaacggaaccggagaggccgaacagatccagcacgccgaggacatgctgctgtttctggagaaccagcgagtttacaaggacctgctggcccgatacaaccctggagtggatatggccgatcaggagagagtgcgactttctgcccgaagagtcggactggaagtgcccgttggaaagaaggactttgaggattaattgtatatagcgtagtaatgagtaacgagtctagacgacgaattatttgtacgagtatactacagtgctgataatacatgaggtttctctgcaaccgcctacttgtagtaatgacgataaacacatgaatttgatacacaaggtggtacttgtgcattgcagtctcattcatttgtgcatttaataaataaatatcatcgtctagtcacatcttctcttaggcggactcgtaatgtccaccggctaccattgtagcaatgagacagcccccgctgttaacaattcatttcctcccactggtccctttgataacttcctggcgagctctaacagcagaccagaaactgccgtagctccatgtcagcttctcagctccttgcatgaacccatcgtatctattgaattgctccgacatatctccattgttagcctgatgctctctgatgacatccaagaacgagtcaccgaggtcaacgagacggtccaacagatgctgatactcttcggagtctctagcaatgcggtcagaagacacaaacgtaccataaaactccttggtgagactattgatctcaagaacaaaatcagacgactgctgggccaagtggtgagcaatgaagaatatggtctctgcaatggtagcggtacagatgaaccaaggattgccatgagaggttcccactccatcgtagacgtcctcagcataacgaccaacaccaacggcgacgtacccaggattttcatcctggaaagactcctcgaactcagctaatcgttgatgattaatagggtagtcgaaggagtgcacataaggcatgatagtagcaatgagaagatcgtcgtagggcttgagagatgtacctgcagctatgctagactcccatctaaccgagtcaagagcggccaagaatatggaggaatcaaggcccgaccttccaaaacttctgggctcaaattgtgcattcagccgagaaccagcctcgaaatgtgtcttgatgaattgtcgaatcgatccagcagtgaatgtacatctgctttcggtctctcgatctgagtaatgtcttgcaagttccacgacgttaatgagagcgttgaactgcacttgagaagtgaagagatggtagccctccagttcctcccagagatcaaaagtcggctgatcccaatactgtagaatgtactcgacatcgggtaggatcatagacttgtagatatacacatagtcgtcgagagaagctgtttcattccactccacctgggtttgaatataatgcgagatcgttttaattctgagtgcaggtccatcattctgaggtctaccccagtgccctgtgaatgctgagccgtcagtctcaaatttaggctctcccaaaccactaacaacacgtctgttccagtcaaagtacccggagggattgctgacgtgctgcaacatgccttgagtctcaatgtatcccatgatgatgttgctgagtgtgtcgttcagtataccttgactagcctggtcatagaaccgccgcacaactgagtccatggtgatggcagcatcccgagtccattggtaatagtagtcaggggccgttttagagggactagcgataacaacgcctacgggaagaccgttgttgctaccttggtgtcccacattgtcgaggacagactcaaaggcgtgatgagtctgctgagcgagccacaactcgaatttctgggcgtcaatgagtgtcacgtttggtctcgcgtatggtgccagcaacagaggcttctgatcgaatagcggaagcgctagagaccctggaagtgctaaaacagaaacaaacgcttgtagcaacatcgtcggtatgtgtgtatgtgtgtgtgtgtgtgtgtgtgtgtgtgtgtgtgtaaggatgagaatagcgcaatcaagccatttatagcaaaagagagaaggtgtaggtacctgcacaagaagaaaatcgtgcttgtcggagaaaagcaaaactgtcacttctgcaccatgcgttcgcgctcttgttttgttgtggtagtattttttagcactcacggttctgcattgagatttacctcttgctgtgtgaccatccttccgcatgaccttggtacgtgataaagtgtacccgcttgagagatgtacaaagatgtacggagatatgatacgtgtgccggccgcgcgtaacgtgactattaagataagtataatattttcgactctacaagcaccaaaaacaggtcactcgttctagtatttttttaccacatttccccagcttttgctttcattctttcataccactaacgtgaagaccaaggttacatgtgtagggatattattggcactactgtaagaaggacaaagaaaccacaagggggccgatgcccacgatgaccctgtggacggagtcctcttctgggatatgagctgtgtcatatgagctgtgtcaggtgcttcacggtccgttgtcctgttatacggagatatgtgggtgggccatgtacggtagagagggggtaatagcatgtagtaagacacacacacagagaatgtcacatgacctacgatacgagtacgagaacacatacatacaagtgcaaggtactactgtattcgtacatacaaagtctggtagagtatgtaccggtttgtacgaatgtgagagtgtactataaggggctgagaatagtggcaatgaaagtggggctggaaacaatgagcaggaccattcagaaaaatcgggattacataatacaatacaagtacagtacagtacttgtacttgtactgtactgttgcagtaattcatgaaggtagcgagattattaagcacgtacttcatcatttggacgagccacgagagatattttatacgacaaagacgaattcgaggtagaatactggaacggcgggaatcagtcaagacccgtacatgtactgaagtcgaacgacttgaaaacttgtatacacagtaattgttcatagtgggatgtcgaggtccacataaatttcttaatagtgaactctaattttgtgaggcaaaatttatagatagtgtagccagatcatcacaatatcagaggaattgaaaatgatacagttgtccaatgctattgtcaaatagttaccatttacaatctgctttccttgaataagtcctacatccgcagtcttcgcgattcctctatcagcacaataacctaaccctgcagctcatctgcaaagcctgaaaaaatctggtgctcgaaaatatctttattcaaacccacgatacatacacaccagcatggccagcgacaaaaagagaaaggcttcgagcaagcggctgacgaaaatcaaggtcgctaaggttcaggacgatggaaaggtgtttctttctgactgcggtcatttgtccatccctaaggacgccaagttctcgtccgtgtctgacaatggagagacctccatcaagggaaaaagctcccgaatgcgatacaccagtgtgcctgtggaccacgagaagtactgcgttgccgtaatttcctctaagggcttggctgatctggtccccgccgaaagcattgagctgaaggccatgtccaagcaactagccaagagagtcgctgagaacaccgagcagaagtcctacagagaacagcgagtcaacctgggtaacgagtttggaactctcaaggcaaagaagacccttgccagtttggcccgaaacaacattgattccaacgagcttgttgactttgaggacgatgtcgtggaggctgtcgctactgccactgccaacctacccactcaagagcaggtgtccatggcaatggatgatgcccgacccatccctaagcataacctcgagactctggatgtcaacgagatctatcctgttgagggatacctcaccgacgaggaggctgggtacattcgaagcgaggccattctggacgagcaggatatcggcaagcgagtggacatgcttccttaccgaacctcacaaatggtgcgagacagtctctacaagatcaccgacaagaccgacgagaccatgtacaagacctctcttctctattatctgtctctgctgattggattctaccgagatcgtcacgtcaagaagcgggaggatatcaaaaccagactcaacaaccccccagagtacctcatcgaccagatgctctaccggtacaccactcccctttctggtggtcacaaatcacaacggtaccacacttacatggtcaactccagaaatgaggcaatgttgctgtgtactatcattattcttgtgctgagactcaacaacaacgttgtagacattcccattctgtcgcaggaggttggaatcaagccttccaagcttgctgacgtttgcagacaggtgggatgcgccattaagaacgcctctctgactcacatggatgatatcggacgacctcgaaccgaggctagccactggaagattgcctcgctcaaggctccgcttaagctaccagagcttgcccagcgacgacgaagagccaagaaatagactaatgcatagattgataatgggtggagatttggatgaatccgagatgaaatattcttacagcgaagtagagagcactgcatcaacattgctcaaattctcactctggttggccattaggcaatggctcgctttgatccagtgaaaatcacagcggacccctccagcgactcgacacagcgatgtcgacaagtctgctactgaccaacagttactgacgaaaaaagttgaatatactcggtatttccgaaagttttgagatgtaccacaatcaccacggcacatgtaaacaaacacacaagtaacaattacttgtactgtgcgatgtctcaacgatcctggtgaaagtacacgcacataagagtagtagattgcttctagagctacacgacacaatacatactcacctcattaatcattaatcttatacatatgtggagcttagataacctcttcggcatcgctctcaatgtcatctccaagcagctcgtcgtcctcgttgatatcaacaggtgcgtagtctcttgaccacggtcggttgctacttccagagtggccgaaaatgcctcgagcgaactcgccgacgcccttgagagcctcggggatcatggtgatacctgcaacaacgtaagccaggcccttaagagcctgctggacgacagggttgctggagctggaggaaaacgagtcctcatcgcccagtcgaatgacaccaaacttggactggtagtgctggaagatcatgaatccaatgacacaagccatggcaataggaacaataatgacgaagaatgtgccgatgacaccaagtccaccaccatgcttcttgctgaactcgcccttcttaccagggcaaggaattgcatcagccttgtcgagctcctggccacccttacaagtggacagggggattcgtcggtagccggtagactcgtagtactcaacgaggttggggttctccttgcattggagggcgtgatcagggggactggcacccttgacaagcttacaagttccgtctcggtctcggacgtagttgaaatcacactcaaagtcctctcgagtgcactcacagtcctggacaaccttgtgtggttggatgagctgtctgccaatgtagcacttggagtcgaccagctttcggtagtactgagtctcgtggccaaacagacagttgctctgctgagtggggtttctgggagaccacagctcgtagtcatctcggtcaggattggactcgtccagcttgcactgtcggtcagagaggccagagaagtcaatgtgaacggtggtagactgctctcccttagaccggggagacttaccagtaagcaggaatcgtcgagagttatcgttgggcacggtggaaatatcatcaaccttgacaagatcctcagagaatctgtaggggttccaggtgacaccctcatcgagagagaagaatacctcgttggtgggctcctctccgtcaacaataaccagaatagaaccctggtctccgtactcccacatgtacgctccctttttaatttccctccaagtgataccaccatcgacagtaaggtaagtgtttccgtcgaggtatccctcgaggtactctccgacgttaccgacaccgatcatcataccaacagcagaggcagacgtgtaagtatctcggtaatcctttcgctcggtgaagccgtgcaagttaagagagcacttctccagagactgtccagaacacgagtaagccttgccttcagtgtcagcggggggagggttcaggtatgcccattgtccaccatcgttgtgggtgatcatggacttgagctgctttcgcgaacccctggaggcctgtcgggcattgatgacaatgttggagacagccacaccctcgaggttagccatcttctcaaagtcgacaaagccgactcggtttcggttaacctcattgagagaaagcataaacgaagtaccgtaggagttcgacttgagaatggcgccgtactcggagttggcctttccgttgacggtaacatgcaggaaaatggcgtgggtggtagattgcagaacggtgtaggccagctgtttggggaccttaaagtccggagggaatcgagccacggaaaaggactcaccgtccacggatgtctggcactcgagagtctcgtcctcgtcattgatgacggcaacaacgaggaactcctcagcaagagcgaaatcaagcacgttctcgtgggtcactctttggtttcggaagttgtcagtagaataagccagtcgggacttcttgacgccaccctcgttgtactcaaacagacagtacatgaggttgtttcgcttctgatccttgagtccgttaacgtactggcacatgatggctccgttgccgacctcggtccatcggcctccgttgttgttggtgtagtgagtgaccaccttacatcgaggggacagctcgtcttcacagccttcggatccggtccagatgaaagcgtccttgttgtttcggtcaaaagtcatcaattgcaggcctcgctggttcgggggagcaggtgttcggaacgacttgaatgactcgcccttatcaatggtgaaaaagaccttctcgtcgggggtcaaaaagtaaactcggttcttgaagtgggggttggggtagatggcaatgatgtcctcgcccttgagcacctgcttgaaggtcttgccctggttgtaagtgacatagagatcgtttttggaggttcgcaacagcaccacctcggcgtcgtcgggagacgcattggtcatatcgttggtgagatagtagtgctcaacaatgagtcccgaaaactcgttgatggtggagctgatttttgtgctgaggtcatcgtcagcctgcgcaaataacgccagcgacgccacgagcaccagtagccgtgtcaataatctcattgtgtgggtgtggtgagtgtggtgagtgtggatgtattatgcgttgtccctgtgcgtctactggagatagctaaaagggttcgataagtggctgtgttcacgtgaccaactgaaattaagcgggtgtgagcaacagaatgtgatgatagtgtgtaatcaaagcaaagaaaatgagctgatgtgagatggagctgtcgtcaaaatccagctcaaacgttttaaattcactgtcgcttcgcgtggcgctcgctaaggtgtatcgtcttgctaatgtcgtgttcagtgtgtgccaaaacggtagaattgtagatcactggggacagccgcctataaatgatttccaaaaaagtgaaaaaaaacgttttcaagggctcggaccggtgaaaaatttacactctttttgtgtttggaattggggtggctagccacggacgggggtagacacgccctgtgattggatagcaaagtcttggctttttatcagatgcgcatgcgtctctcatgggccatatagagggacgtttagcaggtgctagtggatgaaaatgtaacgtattcaggtgcggattcgtctttggtggtctcaaaactcccatcccaacctcgatcgctatccgaaaccgccgtttttgccaccccaggctcctcccatctaatggtgtggtggcaattatgcacactcatcagataaatgtctctttagaattccgccaagcgcatgttctgcagcgctaacaatgtactacaggtggcactggcgacctccgaaactaaggcttctttcctaaatcgaaaacctcggattcgtccctattattgatgactaaagtagttgcactcggatgagtaatcaccgagacaagtctcacactatcatgttcgtatttggcctccccccgcttattccgcactaaccttgttgcgatcgcctgctccttttggcagcgcccgaactgtatatgccgaaacctaacacacaacacacacacaatgtcagcataccagcgagaagagcaaaacaacactcggctcgaggagctggcgtcgaaaatctcgtctttgcggtctgtcaccaatgacatccacgctcaggctagcgattattcgcttattgattccacggtgagtatgacggagagtggtggtccatgaggttgtcatgcggagacgcacacagagagagtgatagagagaggagaatggtgctagaagtcgaggaagtacccaaaagatgtggcgatgattccttgattctgatcatattcacgacgtgccatggtagttgattatcttgttgaactggagggatcacatgctcacgggcacgcgagattataaagtatgttttctcagcaggctgaagaagaccgagcacgacatttcatgatccgaacggcttgaatacttgatctgaatgaagctctgccttcatctggcgggtctggtctcactatctttgttctattggcttgttttacgaacacctctgacttaggggtgatctaagagtacgaacttggatactggcattctctcgatctgctggtttcatctatggtattattatgtgtctaggacgtcctcagctggcttcaactcctttttcctgtatcgtggagcaggggaacctcaaaggaatgcagtaccggggcgattgtacccttcctagacatttcacccagtccaaaacctcacttcttttaccctactaacccagacggacactgttggaaacatgatgacctcggtccgagggtctgcttccaagcttggacggtcgctcaaggccggacaccccatctggcgaactgttggcattgctctggccatcattctcctgctgtggtttctgttcaagtttttttaatgcatgaggagagtagaagtactggtagtaccatgagcgcgttcggcgctgtgtttataactaagaagattgatcgtaacaccacagtaccgatacccacgtactgatctcataatacgcaaagccttatcctatataaacagagagcgctgtttacttactctcgtcctccaccaacgttaatatccttacccagccggtagttggagatggatttgccccagttgatcttagatcgagtcacgggcagctgtcgtcgcagggccttaaacgaatcctcgtttagaccgttaaatgacttgttgagcttctcctggaactgctgctcggctttggagatggcgtccacaatgtcagattcggacacagaaccaaggtccaccttctcgctggacttgagacggacatttccgtcctcgtagtaatgcacatccacgtcgattgttccgctcagagagccactctcgaagatgtacacagaccgccactttccgttccagtagttggcagggttatacttgccatccacaagcacaagggcgatagatccgtcatcctgaggaaaaaccccagcagccccctcggaggggaagtgggcagaaaagtacttatcgagagccccttggatgggcgagtcagagccatgggagcccgagggggtggccttctttgtatcaaaatcgaactcgaacttctggccactctggctgtcatagaaggtgtccttggaaagctggttatatttagagaccagggacttggacttgccgagagacacaaccatgcattggtcgagaatcttgttgtgaacgtcggtttccagtttggacagaatcgagctgtttccatcaacgacggtgctgatggcctcaacgacctggttgagctgcgttagtatgggggtacagaaagacgttcaattggatctaattagcggcctgcaagatatcaaggcacgcgtttcaagttcaagttcaagcaaccgaagtaaatgacgtgacaacataacccgtacatcttgatacaggggagactccgtatcaggcccgtgctgacagcgcacgaatcctcaacatccgtccgccaacaattgatactcacctctccgggaggggcgtcggccacgaaatcggccagggcttcttggttcgatcgagacatttgtgtggtgtgttgaggagatggtgatgtatatgcacaccaccaacagagttagcatacgtgtgataagtgagctatttttggactgatattggcggtgatgagtgaaggaattggagtaggagggaacaaatagaataatttagaagagtcgataatataaccggtgcggttgtattcgtccagactccgttctcggacttcgcagtctaggaacagcggttacttgacaaaccttattagttgaccactttacttaccgaatacttacagtgaaagttggtattacagtatgctgaaaaaaaaacaagaatagtacagtcgtgcagaagtgaaaatgacgaagtcacttcactaccaactacagtattgagcttctgttatcctttttatccatttcaactatctcccatagttgtgaatgtatacgatggaattgtgcctcaatcattccctaaactccatatattaaatgcgattctatagtttccagttgtcgtttctcttcattcatgttttcttcgcccttcatccacgctagaacttggagagccatgtctgtccagggaccagcatcttggctgcgaataccatgaatcctcctaccatcatggtaactcctgcaaacacctgaagtccgacaaagctggtatgtccttcgtccagggtggctcctgcaataggcatggcagtaagagctgcccaggagcagaagaaggtgactacacccaatcgcctcccaatttcatgtggctcggacacttccgccacaagagctgcaaacagaccaatatagggtccagagatgaatccgaagactccagagaaagtgaagaaggccgcgttgctgttggaggggatccagaaagccagaagaatgataccacaaagaacacagcatacggaatgcatgttgtaagtacccaccttgtcagccattatacccggcaagattctacccagaaaggaggctccgttgtagattgccacgaggtagaaggagactgtttcagacatgccgtgggaaatagcgtgggtggacatgtatcccatggttgtgacaagtccccaatacgaaacaaacagcgccgcggtcatcatagcgaacgacttgttcttgtagggttcaataacctcttgtcggaaattgaagaagttctttcgtaacttcttgttaggaggcagtcgagaagagatgcaaacacagcagatgactcccactccaagcatgatgtatccaatgactctcacagtgtcattaaatccgattttaggctgtagttgagagaagacgaatggcagggtcacacctccaatcgacgaacctccaactaccacacccagggcggtagctcgtcgtttgacaaaccacgtgttacacgcgaccattgatgcgtagtagacacaggagtttccgatagacgtgcagattccctgagccagcaggaactggtagtatgttttgcactcagaggttgccatgattcctcccactgtgaagagcataccgacgatagccaccggccgaggcccgtacatctcagctagtcttccgaagaaaactcctccaaccagcagaatgaagaactgtagagacgtgatccacgagacggtcgatgccgagtagccgtctagttgatgatgcagatagtaggcctcgaaaagacccacaacgttgatgtatccaaatgatgagtagagacccagagctcctccaaccatggcgatccaagcccggcccctatcgggctcagggagcttctgcacaaggggctcttccttctcagagattgaaccgctggccacaaccaactggctttccactgatttgcaggacatgtcggtgttcgtggcagtatatttcagtgtatgttataataccgaatctacagtggccgggccacttcattaaatacgcgcaacttctgcatctgctccaactgcttttccgagaacccggccaaagttcagcagatcgtggggaagtgacaaagaccatgcagcatgaagctgagtgtgcggctaactgtgcatattcatgccggcacaagtagctactcggatatacttcacaggagggagtaaaaaaaaagcagcgaaggataaaactgagagaagaagtcagacgtcaacatgaaactgaaaagctgaagggaaactcacacccatttttgggaccttattgttacaaattgaggacatccagctattcgacgttggatctagttcagtgatgctaaccttcctcacggctatcgactcgaagacatgctagcctaccctattttggaaacggcggctattcgtacaagcgccggtacttggagagaaaaggaaaagagagaagactacaatattcgtatgagtttggatgcgggcttggtttgctttggtatacacagcaataagtgagggtccttaccggtagtacgcgatgcccagggaacaagaaccgtaaacactaaggttcgtagacggatatactagacaagagtagagatgagcaacagagactgcaggaagtgcttgaatactacaacagacgacgagagatacttgaacacaggtacatttacaaggtgttaaatctatctaccgtacttgtacaagtacttatcagatgcttaaactatattatatgaaaaagacatctccgaaacccaacttccaaaaccatcaacttgagaatttgagctggtcatatacagcagaaaattctccataccctacgtagtcatattcactgaagattcgacaaacctgtatctactgtatattgtactatggaattgtgttgctggttattcgggactgctggtgcctgtgatattcacctatgtcaaacagacaaacagatactgtaacttgaagtgctttttaaacaacttcaatctaaaataacgctctacagtaacgatgacacagttcaaaattatcagatcacactgtgcctaacctctgtagggtttgtgtcggactccgcagacatacagtgacaaggcttgatacggactccgacaagatgaaaaaattaccttcatatgtctcaagcgatgatgagagcttctacacgagacgtaaatcaatcggactcgaagcatcagaacagaaaaaggggaaaacacggtcttatatactaccacgtactggaggccactgttgctcagcatcaggactcactcttagctgttcataactgctatttccttcttgttgttgctctggttcattgaccagaacatgtaataaacgagaagaaacgatacagtatgcgtcgatctgcgacttctttcgcgaccggagcaccgaaagtcgctcggagcttgctttcactgaaacgaatgtatgatttactgcatgtgtacactgcagcttatcagatgaactgatatcagatggatgcagatctaagggttcggtgcctcggcaacttcaacaaagagacaagctattactaaccctcaagagaagattgagcaacgtcatggaacagttcgcttatcaaaaatttccataattggtgtgagcgtggttcgtgaaaacaatctggtgattacataatcggggccactatcaagtgattcctgaggctgggaatgtgtattatgtagtcactcacaaatgaagtacaaaccgtgatatatccgtgggtatcatctgatactcttcatgttcgactcttattatcctgatcgcttacaatacctgtacagtagctacttgtacttgtacttgcaatccctgctgtaattagaatttctgtctatttactccacgtaccggtaccacgcataaactctacgcgccaacgcgattaacgacaatgtcatcgttcgaaaaagtgctgctgaaccagccggtggtgttcgacaacggctcggggaccatcaaggcgggctacgcgggcgaggagctgcccaagacgttttttcctgcatgcgtcggaagaaccaaacacaccagagtcatggcagggtccatggaaggagacacatttgtcggcaacaagatccaggaggttcgagggctgctcaagctgaaatacccgatggaacacggcattgtgactgattgggacgatatggaacggatatggcaccatgtctataacaacgagctgaacattctatctgaagatcatcctctactgttgacagaagcacctctgaatccccgttcaaatcgagatcgggcggcccagattttcttcgagaccttcaacgtgcctgctctgtacgtgtccattcaggccgtgctagcattgtacgcctcaggtaaaactacgggtcttgttgttgattcgggcgatggtgtgacccacgcagtccctgtctacgagggtttcagcatcaattctgccatccagcgtatcgacattgctggacgagacgtgacggagtacctccagttgctactgcgtaaatctggcactgtgttgcaaacctcggccgagaaagaggtggtgcgaaccatcaaggagaagctatgttatgtggcggcagatccgaaacgagaagaaaaggactgggtggcaagtggaggaatacgagacattgaacagcaacggcccggatctgcaggtggatcaatttcgaccgtgttcaagctgcctgacggaaaagatatatacatcggtccagagcggttccgagcaccggaaatcatgttcaacccagagattatcggttcagagtacaactcgctgccacagattgtcgccgacgcaattgcacggacagatctggacctcagagccggcctttacggaagcatgctgctgtcgggaggaaacacactcatgagaggcatgggagatcgtctgctgacggaactcaagggtctggcgcccaaggatacaaaaatcaaaatctacgcgccacctgagagaaaatactctacgtggatcggaggctcaattttagcaggtctgtccactttcaagaagatgtggtttaccgtggacgagtggcatgagaacccggatatcattcataccaaatgtttgtagttaaccaattaaccaagtatacgtgtacaggcaatcgtagttacatcttgttctgttgtacgtttataataaataagctggagtgcaattactcatcttgagtaagactatcgggatccgatagtggctccagtaacgtgtcggtgatgctgtgtccaatgtaagcctgggtctccatatcactgctagtaatgctgggtttggctgggagaggaggcagatgagcaaatgcttcacgtttcagactgggtctaggaaatacgtctccttcatcctgactgtctgacacataatcatcttcatctaggctatcgttttgtcgtcttactggaatgaccacatcatcttcatcatcatcgttatggtgaggatgggcagagtccataaaaagccccgacatgagcaattgagactctgtgattggttgtggttcctgtgactctgtaagtctcactctcttcagacttgcagacggaagggtgaattgaggtcgtggctgtgtaggttgcttgaagggagagtaccctggagactcgtcatcatccgagtctgggatgatctgtacccctcgatttccaggttgttgtgtaccgtgtggcattttgttggcaagttcatgctgttcgtcatcgtcactaatcgactgcgcttctaggtcctcttcatctctagtatcactaagagactcatgagcgtcgtggtaaatgtccatggaagcagcaggctcatcatcagagagttcgatgggtcgatttctctgagactggctcctggttgtagactgtgactgacaccaatcgtacccttgtccatctctatgcaattcatcgtttgtctcaacctcattggtttcatccacatcctccagcagttcatcgttcggacaatactgtgagtctgagatgatgtgatcagtgctggtggctgaagttggcccgtgttgactcgattcgtgtggaatcaactctttctgactctcttcattttctgaatcatcttcacagctatcatccttcgtttgtgtgtatccagccctctgagtctctgagaaatcatcagaatcaccttcaggttcgtataacgactctcccgggccgtactgggtttctccaggcacgtactgagactcttcttgggtcgatttggcaaaagaaacgtctctaaaacccgagggagtctcatcaactgtttcttcggggtccaaagagtgatgcagggaagaggcagagctaggagcaggcatagaggaaaaagcaatccctgaagacgggcttgttattgaaaacaaaggacctcctaatatctcctggtcttgggaggagctaggcaccacctgcacgtcttcactctcctcctcttcatcgctacacaacacctcatcttgccattgtgagtcggccactatttggccggtgttgtttgaatgttgtgatccgttctctggttcatcatttagtcctcttgtcgtatgtgtctcctgtgcatcctttgtcacttccttctcatgatattgtaatcccatgttgtcgtcaaacacgcctctttctttatctttgttcccactttccgtctcaaatagtctcctggcgactcctccgtccacagaatcatcaaacttcatggtcaggggcgagtagttaggagtggtggacggaaccacaccaacaatgtacttgtctggggttgaaggaggatgtgtcacgtcagcgggggtgatgggagtgattggagcctggctgggtgagggtcgtgacagctctgaagacaaaaccaagggtgaagagctcataggaccttcaaatcgaacagtcttagaaggagcggtaggagcagctggagcacccaaattccccaccagacgcgccttctttccacgatcttgtaacggtgactccatggcagcacgtttacgcgtccagtttcgaggctgcgtgctagggggcattctcgtgttgaaaagaaagtggtcgtcagcaggttgagtctcagcttcggattcgtgatctgattcgggatcgaggttctcaactccgtcaggatcattagcctcatggtcgctgctctccccttgaatttggctgtcgtttagatcgctgtggggctgactatcgtcatacggagtctcacgctcatcccagggctcaacagcctgactgtcttcttctccatggtccgggaggtcttccacaaacttgtttttacggtgcaggtggttcacaggcgccacattaagcgcgttcttttttctgcttcgtcggccatacgttttcatcgtgtggtgcaactggtgtagtagtttcgtgtggcgacgcgtttactgtagttaatggcgatgcagcaagcatgcaggtaagaatgaggagtgctaatataggtgtagcgctaattgggctgtcattgaagtggcaaaaaaaaagggtgagggcaaaagtacatgcttaacaagcagacgatcgatccatatatgttttgtgttattacaactaccctcagctgcaaagcaaatcagatcatgccatagagtcgcagcaaccggatttaggcaatagacctattggtcccttcaagggaacatttccaagccgcatggcttgggcacctattttgcctatagtaataggagagtcgtgatgagctcgaagggcttaaaatacagatgaatgctcttttgcgtaaatccgagctgtcaacaagtaaattcggaaagcacaagtgtggctagttcgctgtctaagttatacacgcctttaccaagacttttcatggcacgtacttacggctcatgattctaaataatatgaacacaatcgcatttttaaattaggaatacaacatccttgttagagtagctactgtacttaaaggctgcaataagcacaacatcctttgctacaccttacctcttcatcacacaaaccagctcgacttcgctccaacttaacagttcttttaacagtacatatcgtacatcacacacgctgctaaacctacaagtatcagctgcactgtgaccaccacacattcacttcagcagtgatgttgttcccactggaaatatgggacatcatcatcacctatgccgacattgacgctctagtccgcctctcgggtgtaagcagctactttctaaaaagctgtgagccgtatctggagactgcctcccgggcatgctttccctgggcacagaaatctctcctgggcgaaccagatggaagtgaaggaacctggagactctctgcacttcgtatcattgcgatgcgacatttacgaccagacttcatcaaccctacaggaacccagaagaactgcaaagatactcctctcagacgattcccagacttcaacagcaatgaccatacctcaagaccattcttttacgacgcgacacacacggtgataaagggagtaccacttgatgatgtggccaaagcggatgctcctccacaggctaaccctgcccctgctccgtctaactctgctctgatatatcccgtggggggagacactcttcgtggtaatcgcagatctctttggacgtctgcttcggagcctacagaaacagagggacacttctaccaggtctactcagatctcaacgggtattacttgaaggtgtacttggaggttatcgataagaccacatttaagtcgaggctgtttcaggttccaatcgacgacgatacagaacggcctctcgacgctgtgtcggctcataacgaccgtctatttgtgacagtagcaaaaagaagatcgttcctagtgttttacttcaaccccaacacggctaagttctatttggtgcttcgagccacgggtcactacggcatgttcacacaaaacagagtgcttgctgatttaaacaccattcgtgtactctcccatgaaggctacttcttcaactatgaactccatggtctctacactgctcccgactttgagcccaaaacaatcataggtttcacttcaaactcaccgaaatggtctcacttctgctacctctcacatccccgttcgaagctgaaaagcacacggtacgtcgcttggtttgctgacgctaacgattttgacctcagaaagaaccgccagtcgctcatgtgtgttgtcgctgacctaaaggagtacaggatgtggcgggtacctatgcactgtgcgctgttggttgtaggactgtaccataacaccattggctgctggcttctggacaaggatatgctggttacccctacacggggtagacgaaaacttttgctggaaaagactgtcgccaagtggagaagcgaccctgaagaattctgggtcatcaagtgatcaaaaaatcaaaacaaaactgtcatctatttattaatgcattctactgtacttcatactgtaaccacatactactctattaaactacctcaataaatcatttcaggaaagatggaaagctcctcctccctcggaaatggcctgcaacagcctactcctcaaaagttccttggtagagaagtccgggcacttgaggtagttgacgcacgtcatgacactgggcagataatcgtctgggcccagtccgttttcggaagccttgcgaaccaccgtcaggccgggtttgagagccttgaaacccccaataggcaacttgggggatcccgtcacaaacgacaagaactgacgtcgctgagactcgtcgaactcactcatcacctcaagtaagttcatgaaggtcttggatcgctggtcaaagccatgatccgcgtgcacggcctcggatagagtatcaagagaccaatcctcaacactgggaccgcacatcagcacaagctctgctggcgaaaatgcacagactgcggagaacgggaacacctctgagaaaccggtcttgaacgcctcaatttgttgggacacgcccgaaccaactgtctggtcgacaatcagatccacgtactcctggacattgtctccatttacaggtatctgacttccattgggcttcagctcggcctgagggaaaccaggaagagtaaagtccaggcctaggtgttcaatctcgccaggagacattctctgtagctgccgaagtgacttgccgagttgctcatcaatggctaacagcgtctcgctggtgggagagaaactgagctgcaaacatgccagtcggaagaatgtcgtgctgaaatgaatgtcaatcagccgtgagtcgatcatggaccgagcaacaaaggttccaagcaccttgaaccgatggagcaccttttcgttgttggaacaggtgatcagtgggatggggaacagcccctgctgtgaaaaggcgaacgcctcggatccaccagcaccactggtaggggtgtcgtctctccacatttccagcgacttgtgtgcaaactgatgcgacacagtagcgtagaattcgagagtgggaccaagtccagtgccgacctcgtcaaagtactcgacttcaagtacacttggagacgagccgtacagctccattactttaattgcgctctggaacatgtgctttcgagagattcggaccttttgacgaattaacttgccaatgggaggtcggtcgtttcgatcacgagaagaagacgaactgtcgttgccattgtggcttcgtcgctcacggtagtgctcctcccacttttgaatacttcgagagtaaccaaacgaagtgctctccaggtatcgatggcgaacatcaaaggggaagaggaatgggtacagccgtgtagcgtccacggtccaagcgggaagacaaagagaagcaacaataaggggctcctccagctgcttgttgaatttggcggtcaacttcgaagacaggaaatgcgaagggttaaggttgtacacgcttccagcaatttcgccactccaaaggttgacgttgtagagagcactgagaagctgcatgatggtagctgctcgaggagagtccgaaaagctttcaggggactgcaaatagggaacgatgtcttcggactcaaacttaggctcatctacaacaggaggagctcccttcgtcttctcgatgttgatggtaaagttggtgttccagatctcagaaggagacccacatgccttgagaagagctccaaacacggtcgtctcgtgagtcacctcctgtccattgatagaaaatgttagatgccacttgggtccagaagaagcagctgcatcagcgtatgactgagaggctccctcaccctcgtcgtcatcagcttcaccagcaccgttggctctctcaccctcctcttcgccgtcctcggcctcaccagtctcatcgatctcaatatcagaatcgtcgttcacaaccccaacttcatcctcaacaatctcttcgtcgtcgtcccctccaacctcttcctcttcgctgaaccccaatgattcatcgtcgtcttcgttatcatcaacctccccatttccatcctcctctccatcctcatcatcttcgttccctccgttatcctcatcctcatcatcctctccactgtcactctcctcgccgactatgctgccgctgggaagaggcataccggtggcagcagcaatggcagaaagagcctgctcaagagtacctcctccagcgcctccactacctcggaatcgccgccgcatgaacgacgacattcgttgctcgaacgccagcgacgtttgcaccttggaccggaagaaatcatccacagccttgaacgtcgcaattgcatggatcgacacaaacatgtttcggtattgtttaggcagatccgtgcctcgctcggcaaccagattcagtcgaacctgctttccaagggtggtttcaaggttgccagagtccggaagaccagatgtcagcacctcaaatcgctcggtgcgagcaagaccctccaaaagcttgtcaaccaagaccgcaaacgactccaggctgcccttgttggagcagaaggtctcaaggaactgtcgacgtcgttctacaagatctccgtggccattctcaaccgtcagggattgcaaaagcgaaactaccacgtcagaatgcgtaagctggaaagtggacagagtggggagacgactctgcagcatatcaagaccttgtttgaagttgggaccatcaagtaacgacgcaatctgaactagatcgccgttgttgttggatgtaacactgttggactcaacgagaccctcgaatcgctgaatgtacagcgcaatgaggggcttgaggttgcacgagaagtcgtagacaatatcgtcttcctcgtcgtcatcagaatcagcagataacgctacaaacttgtttgttgatttgggaggagggggaatagctgaaatctgatccagaatgccttcagaggcaaaaagggggccaaattctgcggagtggttctcaatcaggaaaatggacatgtcgacagctcctagaatgagactatcgtcttcagactggttcaaaacagatgaaatgaaaaccgcaacttctggcaaagcaacgacagtttccgatggagaagctgctagcaagcggatcaccgagtagacaatcttccgcttcactcgaacggtcatggtggctgcaaaaagctcaaacaacaaatgcagagtagaagaacagaaagagttgtagttggggagttgcttgagaactgctgcacgggtaggagatgctcgagatgttctaaaggggccatcggggaatccctcaacggtcactgcgtctggaagaagagagaaaatcagtttgacgcattcctcaatgagctgtgggggagccttgaccagtgctgtgagtaacttttcggaaccagagttacccaaaattcgtagcagcactccggtgatgtcagccttgacaatctcggcggccaggttatcactatgacgagcaatgatcgccaaggtctgcaaaaccgttctttgggcggcactgtctccatggacaaggagcgctgtgagttgagtgacaagttcggacgaaacaatggcctcgaaggagacgtcttcttcatcacacgactttccgagtcgttcgatcgttctggctacggcctgggaacctcgctcaactaccttttggtcgctggaagtcagagtgttggcgagaattggcatcacctcctgtatctgatcaaacatggctgcagacagatacttgcagcagttggcggcaatgttaacggccgatctctgaacatgggtagcgaaaaagtcgaggtgaatgagtgcggctcgaagacatccctgtcggagaagatgttctgcgtgtccgggcgactcgggatggtcgctagacagtttctccagcagctgcatggcctgttctgcgaaatccacgtctgtgaggttggtgagtttgtcagcgaggattttggcaatgccggcgctgcaaatgttggatgagaccgttggagacacctcccacaggttgtacagggttctgcaggccataatggcgcagtcctgggactcttcaaacaaggggttggtcatgatggcggccatttccgaacataggttgtcgacggggaatgagtagagcagaatgtcctggttggacataagaagcacttccgagatttcctgcagcagaatgagcatcacggttgcatcttcggcttgccggacattgtccagcagttctctgacccgatcggcctggaaattcatatgccacgacatgcctcccatttctcctgctagcgaccgcagcagaccgctggcacctccactgccactgacgcctggtcgtgagtcgtcctcgtcatccaggtcatccagaccgtcgtggtcgtcctccagaacctcgtcttcgtcgcggatttcgtcctcgagctcgcgggtatctctgttgcggctgagaatgacgctgtcacccatctctgtgtctcggttgtcgtcgtccgtgtcgactgccatgtcatcggcacagtatcggtctcttcggggcactgtgttagtggtggtcaaaccagtggcaaatgttggtgctgtggcctcaggctctaggccgtctctgcaaattgtctgtatgtgccatggccacatgtctcgtactcactgttgaatctgggcaaagacgtagttgtactggtggtctacaccttgtcacagacctcgagttattagacttgtacctgccagttagattcactctgcagcagtgatgcctatagggtttgggatagggagaggtggtgtaagggagtagaggtgggagacgtggctgagtgccagggtaagtgagaaccagattatggcgcaacgtattgctctcgaacggaacactgttgttcatatactatctgttctatggtaattcactctcgcacgcactacattagctgctacatgccactcacacaccggttaccgattcagtctgatacgtgtggttggccttgctgataaactctgattgcacgacagtcacatggattttgcgtcttcggacaactctttacagaagtacgagtgcactgagcaagcaagcagcatgcgatgacgacgacatggcgaaacaacgaggttggaatatatagtaaatgttccgatgacaggttatgagctgtccaacaccaataaaaatattgtctttctgagctatgaatctatcagcgcctggctcactcattacgtctaaagacacacattaaaacacctttatactgtagctacgctactgtacatcctgcttataccgtagtcaaggcacataatttacctctacattaattaccagcttatatgttacagtaacagtacagtacgtagcaaaaatgggaatatcctgtaggtacggcagtacgtacaaacacgttgcaccggtacgtaccctgttgccaaaaagatatatatacctacttgttatagcgactattctttctctggtatgatgccaaacataggtcatactgtatctacaccagcttgtttgtcagcaggtacatgctggcactctcgtgcttgtcgtggttcacatagacaactccgaaaaactacaattcagctcccacccaccgtaacttttgtggctttcgtattccgctacaggatcacagtttaatcgaatctacaaatgcaatgaatgtatgtacaaagtactaattaccactgtctcgaataggaaggaggtggagcagcggggggataaacgtcttggctggggtactgctgagactggcgcgactcgtatttgaaaggatactgagcgggcggaggaggaggatacatgttggctcctccagctcctccgataggtcctcggttgccacccatgggcggaggaggaggaggagctcgtcgggcgtagttgttcttgacggggtaaacaggcatggcccgctttcggtgtcgccatcgtcggaaacatccaatgaggatcaagacaatgatacctccaaccacaccaacaatgataccaacaaacgcacctgtgtttctgctgatccagccacccgcgtcgtcaaaccacgatcgaaagtagtcgttggtgttacccgaacactggcctcgtaggcacttgccgcctcgaccacagggagttccgtcaaggaaattgtactgcgaaccgaaacacacattgggcaggttggggtctctgcaagaaatggaacatcggccttgatcacacgcttgggtgacgttggcaggagtgttgccgacaagggtggttctgttttgcatcagagtgaaacactgaagatctcgagacgtgcacagaccagcaatgcactgaagacctccaaatccgggtcgggagggatcctcgcatgatttgccattctcggtagtgagatcaggagggcaggaagaagagttaccagtgcagaactcggcgggatcacagggacccttggaagatcgacactcctgagtggagggagcaaactggcactggttacaacaggcctggttggcgtcgtcacaaacagctccagttcggaatttgcacgtcttgggatcgcagcaggtgttgcctctgcatccctcttctccaccacagtcacagtcctctccctcctcgacaataccattaccgcactcgttctcggtcagcaacttgataccaccagtgttgtcaatcaaacaactagtgttaagtgagttacgtccaataccggcacaaatattacccttggtacattcggagaaggtagtttcttgttggccagaagcaggattcatgatccactgtccgttggcgttgcaggcagaggttgacataggacagcagtcattcttgtcgactgtaccgtcagaacaagtctgagaagtgcaatcgtggacagccccaaagatatgaccaagctcgtgagcccagactttccattccagagaagtcttggccaccacgttcgtgccagccacccaggtgttaccctgctgagaagctcgagcaccacaaagcacaccaagccaagacagtccgacagtggagccctgagcacagtcggtgaacaatgtccaggcagcaattccgtcgctggatcggtcacctctccattgagaaaatgcagaaagacggtcagaaatggcgttgggctgagttgcagtacactcgtagttccaaggagctgaatcaacagcagtggtggggcagtcggtggaattggccagaacaagagccttgagaccaagagaaatgttgaacgactgctcgtagagctgcgagatggtgttcatgttggcgagaatgttggctcgcacagactcagttgagttgaagtccttcatgtagttacagtcggcagctgcgccaattagtgcaatctgcttgtggttggggcatccagaagtgtctccgatggtggaagaaagagccaggcctgaagaagaacctcctcctccgatatcagactgtcgcttggacaagatagtcatctccttggtgacaaatgagtagtcggtaggcgactccaggtccttggtgtaggcatcggactctctccacaccagcatggaagtgggcttgtcgaccagcgctcgcttcatgagcttcatctcggcttttgactggtcgggatcggcgttggccatggcccggaatgactcctgatcggaaatgtggtagactgtgccagggacgccgagcccggtagggtcgtccaccatccaagcaccctctacctggggctcttcatcaggcaccttcttgaccatgatacgagcccagccaacctttctgtaagaggcagccacgtcaccggtctgctgatcgtacacattgagctttctgtatgcggttcccttgtagagaagagagggagtagacgacagcgctttgtccagcatgtccacgtcagaaggagtcaagaccagcttgtactcctcgaatccggaaggagcctcgatgggggacgaatcgtttcgcatcagatacttgaacacgtctgtggggtctcttgtccagccctccagccctccatgggctgcaatatcttctccaatatggcctatagagcgtttcttgaagaagctctctgcatctctgcgggcattggggtccgcgtgcacataccaccgctgctgtagtcggttgtaatgagcgcctccctctggaatgggcactttgacggacagggagaaggacgagtgtggttgcagcagatccgggtcaatgtggaaaattgtgtctgcaggctcgacatgcgatattggctcctgccgtcgtaacgacatggccgacgccacggtggcgatcgtgaagatgtttaatagtttcatctgggttagtagtgctctcaagtggtaaaaacaggccaatcggggatgaagcgagaacacaaataggggtcgtacatacgtgtatgcgatgagaatgcggtgagtgagcgtgtgagtgtgtgtgtatgcagagagctcgttaaatgcgtgtgtcgtttgtggccgtggtggttctagctggtggaagtgactctcttctaaagtcgtctatctctatggtctggagaagctgttctctttaaactgcaccttccttggaatgtgtgcgggtgtagagtttgagctaaagaaatggtgtaggtagtgtgaagagagggtgggtgagctgaaatattaatgaaaagcgctgtgtatcgtcgtgtgtgtaccgagtggtttcccttgccatgttctgatgttctgaaacagccccaaccgtgaggccagatctccaacgttgtgcgtgcggcgcagcagccctgtacataccttaatatggtgtcgcgaatcgaagcgtgtacagtgtgaaaagagtacttgcactatctatataaagaaagagagatcatgcaccgaagccgttcggcggagcatctgcggcctagaagcccgagccttgttgcgagagtataatacctcatcttggcaacccgcagtgtctgccaaagggtggtagtatttggctctttttttccgtggtttattttagaagcacacactatttcgcagtgttaaaccgaaccttgtgtcaatcaccatgcatcaaccttgttagtcactgtaaaaatagcataatgaaaataaaattgaagcaactcaataaatagcagcctaagggaccatgatacatctgctgtggctatctgcctgctgcaaagtggggggggacaatatgtaaatatccactcgtttccaaggtgatgatagtaaggctagaactaacgacaccccccctcgcgacgtcactctttctacagtctccctggaccctgacaaattatgactactcttggtgtggtagctccgccaagcctttatacagcaaaatggagataaaacttatggttagggtgtgttacgagggtgtacagcacacagcccagggcagtgttgcggttggccgttagtgggtggttagttcaatcaagacgcccacatacaaggtagggtgtcgagaagaccgatacgctgtgcgtgaactgtgcgtgagacacatgttatttgcatcgttgtcttgatgtattaatctacttgcatgaaccagtttcgcagtccgtgcaagctggagtggaggaagaggggttcgtatcttccttcttatcagattctttttgcttctcctgcttttcctccttcttttccacttctccacctttatgtccgtcgatatgtcctagatcctgcttcggcgaaatcacatctctgaccagtttcttgagatcctttgagtctgggttagtactgcgccatgctgctcataaccccggttttccgacagtcggcatcgccctattggcgcatttgtcaccgttactaaatatctcagcaaagtgcaggcaccaggggctgtgggggggctgtgtgtgggggtcttctatagctgtccttcgtattattgaccgctcatgtgaccttgctgactacttgccgagtacttggcggcggttagcagaacagcaaccagcgttacgccatcaccgagccccctgttcactgttcaatggcacttaagctgactgggttggactgtagtagcgtaataccaagagctgctgcaacacaccacatgatacatattgacaagtgtctcacgggccatccggtcaccgtattgacaccactcacctgggaatccgccgttggtttttctgtcccacagaagaatcggcttggctccttcttctgttacaagctcgatcacaaaggtgccgctggaagcaggcaacagagccacctctcctagttggtttccaaatgtagacaagagctcctggagataccaggccgctcgaaggttccatttgcagcccgtgcagaaatgaatagctactcgagggtatgcattcatgttgtgttggtgtagacaagtgatctgtcgatggtctgtcgatggtgctgtgctaatctgtacgaccgttgggatgacgtcagatgagggaaaatcacattatcagtccggggtatttaacgttaggctgggagaaaaatatactgtacagtagaagtgcaaggtacagtgaaagtacgagtactgtacatactgtagctgtggatgtagagaagacaaaagcaaacaaccggattttttgtacctacagttggatactgacattggaagcatctatatctctacttttaattcagcatattgtagtgtgtcatgtttgagctggtttggatggagctgtacttacgagtgtgttatgtacgctggagggtctggagagtctgggttcgaagtgcggagttccaccggggttcgaagttgaatttctgccgttattccgaaaagtcgtctttttattatattaataatcccattgtgcgtgagagtgcaccatgtgcccaggagaagcacttgaatgacttgctgagaacattagttacacttttcttattgattacttggacaaatctgcagcctcatctcccgcagaattgggagagaactattgccagtattctcagaacatgctctcataatccggcgtttgcgaccattcaataagttggaaacgggcatctcaccctcccgaacttctgtgaaacaccccagcctacattattctgtttttacctcggctaaaattgctcctataaccgaactggtccacaaccacaggctgtgatgtggtcagttgtacataccgtaatgtacatattgagagctttcgatcttatcggccagccgaaaccgcccagcaaagcgataataccgccacctggtcagtatgttcacattccatcaaatggcatttatagcaaacatcgtcgagtatttgaggcgtttcgataaggccaagatgttgctccgatattgaaacagagtttcgaggcggctccgaaagagccgagtcatgtgacttgtggtgtgtttcaagacgaatatactggttaaaatgttcacaattatgcttccgcatccatcctcgtcttgctgtgcgttttctgacctacagcatcccaatatcttctctttttcgggagtctaggcctcgtttacgaaccgatgacaaacaccgcataggaccacatcccacataggttacgtatccggtgaaactggtctgatgaattatattaattaaaaggaatgactttatgggagggtttggtggctgtaagcccgatgaatcgactaaaaatcgagttggaatcactcctgaatgctccaaatacagttgttatggccccctctgttcttcaagtaaatagacgcaccgccacacatttgccacatttattttctcttacaaattacacttgccacaatttttgcttcgctctttctaccccagatttaagttgctggtgggtcaaccgtaagacttatcaacagtacctaccagatgaacgtggtcatagacaagggtagagacggggaaatgacattctcacaagtggtacaagccgcggcaaacgtacttttatacacccgtgggactcatctaagacttagctccttatctcaacccctcttctttggatggctcccaaactcaattaactgcaagagccaacgttccacccgcagttatcgtgtgaccccatagtcgttgccttcttcctccgcaattcttctttccccaactctttctcctacacatttttgaccacccgttaccgcacgaaccaccacacacccccaaaaacacagagatgaaacccgaattctggcaagatcgatggaacaaggatcagattggctggcaccagaagtcggccaacccccacctcgttaagtactggcccaccctcaatatctcgcagggatcgactgtgattgtgcctctctgcggcaagtctctagacatgcgatggctggaggggctcggatacaacgtgctgggtgtggagctgtccgaaaaggcctgcaagcagtactttgaccagatggagctggaacccaaggtgtccaagaacgccagtggaaagttcacaatctacgaggccggaaacacccagatctggtgcggtgacctctttgatctcgacgcagacgatgtcaagtacgtgtctgcgctctacgacagagcctcggtgattgccctgccaccggacatgcgagagcgatacgccgcccatctgggggctcttattcccgacccccagggcctgatcatcaccctggattacgaccaatcgaagatgaatggtcctccccatgctgtttctgacgccgaggtccagcgcctgtttggcaccaactggaagctcactttgctggaggaggttgacaagaaggatatgttcaaggaggagggcatcgagcccgttgagcgagtctacaagctcaattgattttgtagagatgttaatgactgattatgagtgcttcaataggctttgttgcataatacatgcagtgatgtagactggcagtctttggttgctggagattgtatcgtaagtactactgcgaagttgccaaccccggatacatgttggtatcctacacatgtctgctgcagtttcagatgtgcagcatgactgtgagcgtaaaagatggaaatagaccggtgataatgagattctgggactacttgtggaatcccctgattttggagatttcaatgcaattttcaaatttcccagaaccccgttaatacggcatttaatcaccccttagttatacaagtaggttcgtcaaatgtgcatatgcatacgtgctataattagaacttgtcaaggatgagtagaatcgcgtgtttcgaggttctttacgtgttatttaggggattgtatcgtatcgagctccctgtcgatgttctagataggctatcgcgtctttcaccatctcaaacgccatctcaaacattaccatatttgccatgtttcaggtggaaattaactcccaactgcagctcacgactatacgaaaataacacgctcaacaccatcaccaccaccactacacatacaacacatccccaagcactcactatgcccagctttgcagactcgttctggtcgtcggactacgcggccggtctgggggtggtgtttgaccagctcgacaagggctgtaacgaaaacgacgaggttctggcgcttgtcaatgctcgaatggaggctgaagaggcctatggaaaccgtctcaaggagatcccgacgcagtttggcgagaccaagaagactggcgggttttttgcgtccaaaaacggagctctggacgaaggagcgtctctcaaaaaggcctatgagggggtgcttcacgagatgggagaagagggaaaggcccatctgactatcgcctctaacatgcgagatatggtgcatttgcccttctccaaatgggcggacgaacatcggcaacgtgtccagtactcgtataaggtgctgcgatccaaggtcaagagttacgacaaggagtacgtggaggtacagagagcccagaaacggtacttcaacaagtgccggctttacgaggagctcaaggaaagcagtggcgagacggttaccccggctacaagcgcctctccagcttcgatcgaccgtcagcgatcagcttccactgcctctgacgctactaccattgtcagcaagcccagtatcaaccaccattcgagagcagagtcgataactgtttccgatccctcacgtgagctgtcggatattggaggacaggtcttttcttctgctgagcttgggaatctcatgaagaaagcccttcaggatatcaaacgtgccgatctcaaggtcgcgatcctgggaacatacgaaaacgtgtcttctggcgatcagattgtgtcatggattcaacagaacgtccccattccttcggattcgtcagctgtggcttttgctgagcgatttggacaggatctcgtgacccagggctatttgcggctggtgggccaggttggatccaaattcgcaaactcgtctgccttcagctaccaatggcgaaagaaggctttcatcgtggctggacttcaggacgatgacgactctctggaggctacagtcgacaaagtacgtccttttgtaggcgagtatcttggagagacgctctcttcatacgtttcttctcgaggcgctcccacagatgagtctcctattcagcgcgcccttcgagaggtgtctgagctggattctcgatacaaaatccaggttgctaagcttgacgatgtgcgatgtaccctggaggagtccgtcattgaccaccttaagttcatggagcgatgcgagagtgatcgactcaaggctgtcaaggctgtgttccttgatttccttgcagctgcttctaactcgcttcccgctcttcagtcgtctgtggaacgactgctgctcttccaggaggctattcatcctgccgccgatctgcggttccttgtcgagtcgttccgaacaggtcctttcactcccaaggtgacagtctacgacaactactacaactcgtccgattcgcagacgactttcggcctggacttggaactgcgttgtaggggagacagaaggaaggtgccgtccattgtatctaccgttctcaatcatatggacgaccagtaccctcttttggacaatgacgaagtgcgtcttaatgtgtggactgtttctgtcagtctgaagacaactcatgccctgagaaaggaattgaatacaggaaaaccagtggacaaggcgattctcaaaaagtacgagctccccgttgctgcatccattctcaagctgtatcttttggagcttcccgattcattggttcctcatcagtactacgatgtcgtcaaacgtctgtattctgcaggccctggaggacagcctcccagccccgaagaacgaatccagtcgttgcagaacacctttgcacagctgttggtatcgaacattgccactctggacgctattaccacccacctggcccgtttgatccgccttactaacgctggagacgagtacattctccagctgtctcaggaactgtcgcattgcttcctgcgacctcgggtggaatctcctgttacgtttggagacagacacgcctacagactagtcaatgacctactggtgtaccgggaccagatttttcccgagctgaagcgcaaaaactcagcttttcgatcttccaactccatcagcaagaagtccacaaagtccgagtcacgtgattcgtcacgtggaggggcagtcccgaccttttccgactcacctgttcgaagacagtcgcttaagaacagactggaggctatcaccaagagtgagcaggacgccaaggagtcggcggctaatgccgagtccagttctggtactgagtctccaggtaaagatattccccctcctttgcctgacaagcgtcctctgaagggtaaggataatgaaggaggtgctccccctgtgcctgagaaggacgtcaaggacggaaagggtcccaagggcaaggttggcaagatgtacgaccaggaaaataacacgggtagtttctcgtccgtgtcttcgtcggccatgttcaatgtccagctggaggacggtaaggagtccattgttattgatgattagataacagtagataggtattttattttataagagttatgggagctcaagtgcgtggcacgtgagaacgagcagtaatgacagcatgtagaagtaggtagcaatctgaagtgttcagtatgtatcgtagccaattccatgcagttcattgttggagtacaagtacaagtacagtacttgtacttgcactgtgcaagctggggtgatgctcgaacgtgggttacaggtacttgtacttgtacttgtaatgatcatttttatcaacatctttcttctcgaaaatcttcgggttttgttgtcgcttctccccgttgcagttatgcaaattgatttggtcctacatatggtaagggacaaagagtggagagttggagagtgttcatcgtgacataaaaatgaacaacaagtgattttttcactaaaaataccaatataagacgatcaacactcatctgaaatcaattgggcctcctccaaatacaagaactagtcttcgagctcaatgaggttcaaatgtggctgttctcacacttgaacatcatcaggcaaaagaacgattaaacaacaccaatacaggtggtatccacactctaccaataattatcacctccaattttacaaaacatcattagcaatatatcctcgaccttacatgaactcggtaagatactccacgaagagatcctctccgtctcggaaaaatcggccgtttccgaccatggtctgtccaacgacccagctctccttatcgtccttggcctcctcgtcaagctcaatggtgccgaaagacttgacgttaccggggggaccatgctcagtcttcttgcccgtaagaacctcaactagctcgggagaaaagttcaggtgaccggagtacttcatcaggaacttcttgtcggagtccttgaggtggccgaccagaacggcgtccaaaatggcggtctgaccggactttgtggttcgaatcacgtcgtgaccagaggtgatgacggcctcaaaggggtacttggggtcctgggaagagatggttccggtgatgttctggacgtagagcacgtcggtgagacaagggaattggtcggagatcttggcgacgactttgagcacgggcattgtgatttgtgtgatttgtagaggcgaggcgttgtatgtcggtcgaggctggttgtataagtaatagcatggattggggttaggggtcagatagcgtaggattaggttcaggataaggttgtaaggatgtctcgtggtgatggaggcatactcacgatactcgtcgctagctaccgtgattgtgttcatatgactgcctaattacattaaataccactcaattctgcaacaattatacctatcgataaaatgcctacgctccttgtctcgtactctgtgcttcccatcaatgtgacccccacaaagccgcataagcgttgaaagggagaaaagcgtttagttcaaagtaatatggaagttgaccgaaggaggtgccagtgtcattcgggtaaccagcggtcacagtacaattactgtaccggtacagtacagtactctatctttaacgcttcaagcacatcttgacagtgatcgtcatatacagtaactgtgggtggttttaaatttcacagcatgggagtgcacacaagtcaatagatgccaataactcatctaggggctgaattacccgttttgtaggaaagatattgaaaaataattcgtttatgaagatatgatacaaaactgtgtatcacaattcctcctctgacatcccgtttgctccccaccaaaagaccctcacaacgcctcgaacaagctctcagacttcgcattttatgtacaagcagtattggtaatctgacggacttaaggatcgtttaaatgattgataaaagcgacctgatttggatggcttcttgaaaagcgcgtccaagtgctacttgactataaccgtcgaaaaatcaatccaaaattactgtacgtctgtaacaaaagtcacatcagaatcaaatcacgccagttggtggaggtcggaattgaaacatcagctggtacagtttgtagaagtatgcacggtacaagaactgctgatatttccaagatacctgagcaagaacatcagctataaaatagatatcaaatcaacaatgcaacatggctggtctcaccagcactatactcgatcatgtgtgatctacattacaccgccaacacacttttatctcctaaaattcactctctgacccccacatttctaatgcatccatttataagccctgcatggtatcacaccacgtcgtacattgagatgattggatagagatatactggatcgatgggtggtattttcgtgtacaatggtttgcttgagtcatcatcctcattctgagagtccaaatgcgggttctacgtctccgatcacaactcacatcaacctatcaaccgccgttacattttaatcttaaacaatttgatggagttgtgagtgacagaacgaggcaggattagtgcagattttagtcacgtggtaggaaatctgaagagtgcatttggtttgaaatgagcagcagatcaatcttgtgctttccaaattgcaatcaggctacaatgcggtccgttcatggaccactcaatctgtagtcatcccatcaggacaaaaccaaatgaagtcagtttttaatcacggggatatccccataaagcagcatattaatcactacaaccacggtcatacaggacaggtcctaaccgctccggctatcaatctgaaatcagtctgccctaaacctgaaacaccttccccagccgaactttgttaatgtggcaaaaaaatccgccggatatccgcttcgacccgggaagccgggctgctgcattccatgcaacgttgtttgggggctatggggctagggcagagctgaatggggcccgtgcgaggttagggtggtggacacagcaggaagatacaggttatgagttgtcgtttagttcctcaacaaagccggtttgtacttatatcgcactccttcaaaggcttctttggacgactcggttatcgaccaaacctttttccaccaatgtgacattgatagtcatgtgagataaacagcgtgttgtggggttgagtataggatgcactgtttttttgatagtcacgggggagaggtctgggtacgataattgtttcgatgtcatttgtgtacagaaatttcataattatcgtctatctcgggtataaatccaacacgtgcgttttacatgattgtacagttgcaacgctgatcttcaagaacgttttcatttgagtggatttgaagggtttaaaatctcaggttatagactcgtgtattgtcttgttgtaaatcagcaacccctcattagccacattctagttttattagccacacaggtgatgtgctttgtgggcacgcagtttgaccagtatgtattgggatgtactcgtacatacagtatgatacagaaaggagtttgtttgagtccggcttctgcccggagaagtactcaaataacgcactctcttctcacttacaatgcgccgtattacagctcggttgttgtctctttctttgcctttttttgcgagggctgtttttaccgcttgcctcagagccgtaccgctatcactaaacgttaggggacatctcgagagtttattttcgagggtcatcctctaacggcaggtagtggatgagccgtggggtatataagaagagagtgtttgtgggtgagcgagggaagcacaaagattcacttgcacacacacaccaacagcgtgcaaaatcattacgccaacacacattgtgagtatatgagatatcggtgattagtaagacatcccgacagcgcaaggtttcgatgagatgcagttttcatttctgtcaggtaacggttaccggccttgaacgtgagtgaagtcgaagttgccagagagcaatgaagtggtgctccgctgtacctaagcaactgttatttcacaagtctgaacgcacctacacacaaaaaacagcatgtccaggcatacaaagacgctactgagatctggggtgcatgatcacagatgagatggttgaggggaggtcacgagtgtgttttttccaggccgaggttgggaacttgaagtcatgtggtgctggagtacacggtgcgagaaatcggtaattcctggttcactttctcagccacagatacatgttgcatgggtgtgatctgcttctgtgttggatcagtgtgatccattgttatgagatttgaaccgtatgagtcgtctgtcatacaatattgcgggggttgtgatattatgctacccgatccatgataatggcagctacttgtctctactacaatgctgaatctcacgtgattgcatttgagtatccagtttcaaatctggaatcacagtctctctcttacacaaatacaacagataccgaacgcacagtgagtgatgatattatcttcttgtcgccacattcaaaagaaattacagcactctctcaaccacgaacccaaccagattctctctgcattgcagtacgttcaacagtgaatgataccccacatttcagtcgaaaccacgccatgctacagggttgctctggttacagtgagatggcctgtgacagtgggagtattgtctgagaatggtcactatgtcctcagatctcgacatgaaattcgtgttctactagttggtttccgctccttcccccttcacccttctagccccgttgtagccactccagaaattggccaatctttcccatactaacccagatgtctctcagagaaattacttcacccgacgaaatccgagatactcgatctttcagccatctcgaatggggcgccttcctctccattgatgattacaaccaccgagaagagattgttctcggccacactcccatgtgcaagaaccgactcaaaagctggggtctttatatcgaagatggaactcgagtcgctgcctgtgagacccttgagcgacccgctcttgtccagtgcaaagatggaaagatcaagtcgacctcgactttctccatcggagcagtcttcacccccaaggagcacagaggtaaaggttatgcctcagtcatgatgaagcagatggcctctggtatccccttcaagcccactctcactgatgctgatatcattaaggcaaccggagtctctgacgtcgaccagacccttcgtgtcacacctctctggagtgatgtgggcacgttttatgagaagtttggatggatcggcaccaccgacttgcagtatgtctttgaggttgatggatctgcttcacaaaacggtgtcaacggcacccccaatggcaccaatggcaccaatggtgttaacggtcacacaaacggtactaacggccactccagcgccgtcaagtacctttcagaggaggatgtctaccgtctggcagacgttgaagcttcttctttcgcttctgacttcgaaaagttccccttcaagggcagctacaagtgcggaatcgttcccgatagaactgtctacgagtggcatcttgcccgagccaagttcctggccaaatttgccaaggtgcctgagcccaaggtttttggggcccagatcggtgactcgtggatggcatggcatcacatgtacaatgctcgagagctggtaatcttgcgggccaagcttgccaaggccgaggatctggtggagctaattgctgctgccaaaaaccatctttgcaaggacggttttagcgatcagatcaacaagatcatcctctgggagcaggagcgggaatggaaccacatcgtcgacggactctcgtatgatgccatcgaccaggctattgagaagagccagggaaagcgtgagcaccgaggatccagtatccccgctgtcatgtttgtcgagtacaagctgcagaaggatgctatggagtttgttgaccatggaaaactgacttggtgttaagccttccgctgaagtcaagatatcggactcggaggcctgacctgctcactgacaaatgacttgtacgtcagactcagacatgactttgctgtgttatgcaatcatgactctggcctttcaaaacgcacccaaaacgcactaaacacactggctacattgtagttcgatatgtacgtgatcatcgtataactgtaatatttatataatacagcaggttggttaagatgtttggaagtgtgtatgaaaccaacccaactattgttggtgaggtctgtatgactagaaatagtatgtacaccagtacataaactggtatgtactttacgatagtaaggtaatcatgaccagttgggtcagcgtacattatgtacacggtaggtaatcagtaatcagtctgtatcaccagttagtcttcggggctccgaacgcgtcctttttagtcgtcaacacctctatcggaagtccgttctcgaagcgagagttccgagatacagtaatcatgctccactcggactccgaacatcggcggtgatttgcatggtgaaggacgaagggggaagaaggactccaggtgcttctttggtgcatgtattcagatcacgagagtttgatcggacatgattaaatctttacaatcagcagaaagtcccgtgtagtacgatacacgatttagctaatgcatgtcgtggcgggggtggtgcaaaagggtgtgtgattggtggtattaggaaggatggggagtgacagagagtgcgcatgtctaattatgagggccgaacaattggaacacagcccgtgtgtattattataggtggtggtttgattactccaagtgttgcaggtggctataattaggtccctcccaccagtatgtacagtaacttgtacagtgcacatcatcaatatcaagctgtatgatctgtcagtagtgcctctggtgatcccgattcaaacaatagcacttccgagcggtacctcatttcccgggcgaccttatttcttttggacaatgaggaatacctgtcaccgatatacttacttccgagccaatcgatgagattgaaaagataatcggacctgattcgtaccggtgcttgtactctacaggagcagatcagcaccacagaagccttgtagacgctacgtccgaaccccacacacgctgtagaactgcccacagatgcattcctgagcgattaaaacccgactaagctgtccgtaggctcgtctaatcaatccgcttttgatgccggagttgaaacctagaaaataaggtcaagcagtacctgacactgttcattctctgatgtgaggttgtccaatgggaaaggcggcgtgaaaaaagctgggacagtgtatgcgttggagatgatgacgtggccagagtcgggttggagctgccctgggtgatgtcagaataggtctgttttgccgccgggcaccagaactgtaatttgtatgaaatgtatggggtaataaacaactgctatggcaccgttaacaagcctcgagatatccatatgttctatcaggtagcatcgttggactgtccccggactcgcacaatacggttatctacaagtagccggcatagccggattccacaaggttacaagctattttccgacgggacgtgtgcccatgcgtcttgggtccagatcagatactcgagctatacgggtacgggtaggagtacagcactgtcgagattatctgtgcgtgccaagcatgccaagggtcaagagcgacagaaccgacgggggcgcggacaatcagctcttctgatctcccctatcagctaccacttgcccaaactactcgtattttcgagcaattatcagatggcctcctcctgcgtgaggggatggtgtcatccaatcagatatcgcagtagtcagtgtctaaagtatatttccgcgtaaacagcatggaatcgccccgacatgtatcgttgatcaacaccgagctggggttgggcaatatctgtacacacaaccatacggcgcttgggttggtgtcacacatccattcagttggcttaacaagcgcccgaccccgttcggttgtggcttgatcgcctgatcaaaggtaatcaaacctcaagaaagacctttaacctacaatgtacaaggccccgacacacgggggacattggcagcctatttgtagccgtatacgaggtgggacacgcagccttggcctgctaagaccagttttacgcgctcgagaggcgaccagcttttcaactttaaagtgaaatgaaacttggcatacgtatttgtagagaggttatgtgaacaggcacttgaaacttgaaattaagaaggaacagacacgaacgacaaccaagcaaaccaagcaacaattgaaagccacagatgttagtggctggcagaaacaggccgtatctcccgaggcgggcttgctaatccatcctaacacaaacgcaaaaggagccacatgtgcgtcttcatcatgcataattacaaatagacatacggtgattggccaaaggaccccgacgatcagagttcgctccaaacacaacggtattacactctattgtcaataacccttgggctgttatcagatggctccaagagagattttaacctgcatggggccaatcagcgcacccggaattgcaattcaggggtcttgtaagcgcttggatgcaggtgggtgtgtgtgcgatggagactgtggcacgtgcgggctctacttggtgttttccgggatccattgtagttgctggaggcgctgtggcggcttggaaaataatgtgtttttaacctataaccattgctatgaaatgtttgcggtgcacacatagctgtggcaaagtcggaccttgtgctgtaacgtgaccgcactgctcttagtgtgctgttccataggctttttgcatgcatcgacgtgccaatacaaaaacagacggaggacttaaactggtacacctaaaagtggcttaggctaacccagaaatatctttctgtcgcgcgccgccaacgggggaggaacaataccaacgaggacatcaggacttggacacgacgacgattctcagacggtacacaagctcacgacaccagacgacaaacccgatacacaagacatagagtccacacacaaacgcatgagctcttcttttgccgccatcaaccgggcggacgaaacggccaggagcaacgaatcgacgccgagcgattcaacaaaagctcccgcccaagcaaaagctccttcgacacagccacagccacagtcgcagacacagacaccaacgcagacgcccggatcacagacaccagtgccacatatgccaccgcagcctcatgaagacacacggccagcagcaccaacacagatggcaccaacaacgacacccatgtcggatgtgccagctcaccaacaggtgccttcgcagacgccgtcccagattccctctgctcaggtgattccccccgtgcatccagcacaaccaccctcagagatacagacacaggctcactcggggagggcgacggaggacgtgtcgcagcctccgcaacaaatggagggcgtggctacacaacagacacaaggtgaccagaaacacccagagagttttgcaccagcaccagtagcagcccaacaggcaccacccgcagcacctgtcgtggatgccccaacctctgttaaaaaggaatcgacgtcgccaaaagggaaggaaattgcgggaccgtcactttcgccggtggcttcgccagcaacatcacccaccgctacgaccaacgccccgaaacgcaagaaaaaggcgtcggtcattactgctcaagtgtgctccaactgtggtactacccgtacgcctctgtggcgccgagctcctaacggagccaccatatgcaacgcctgcggcctatacctcaaggcccgaaacatctcgcgacccacgcatctagagaaaccaccggcaactgctacaatttatttgccaggctcgcaatcgacatcccctgccctgtctgcagccgaggtggaaaaacgagacagctgcgaaacacgggatggaggatgctgcggaggcgcatgcaagccttcaaacatgccggacgacaaggacatgcaggctgcatgcggagatgtcacactgggaagttgtccaggagacggccattgtaacggaactggtggatcggctgcctgctcgggttgcctggcctacaataaccgtatcaacaaggcagtccagcttgccaaccagcgtaaggacgatgatgggacgaaaactgagcccgagacgcctggaactcctgtttcaggctcaagatcagtggttgtcattgcctgccaaaactgtggaactaccatcactccattgtggcgacgagacgactcagggtcgaccatctgcaatgcttgtggtctgtactacagactgcacggtgtgcatcgacctgtgcggatgaagaagaatatgattaagcgacgaaagagagtcttggagaaggacggtgggggagcagcagggtcggcttccagccctggttcagctgctagtcccgtgcccacagcagcagccacacctactcttgtagcagcaccaccaccaacacaagcagcagtgactccctcttctatgggtctgggagtgactggagcgccagtagcagcttcagtgagcccatcggctgtggctgccagtccagctggtactccagcttctctgtctggcacgccaattggcactcctgttgccgcagctgctacacctgccgcatctactcccactcatcccatgcagcagcagcagcaacaacaacagcagcagcaacaacagcagcagcctcaacatcttcagcaccttcagcagcagcagcaacagcagcagcacccccagcacatgcatggggcggttgttccccctcccggagctcctggagctgaacatctgccacctatgcattacccttttcctcaccctcctcctcctccacaccctcatgctcatccgtactactacccctactatccctacccctacccctatcccatgcagggaatgcctccccctccaatgcagtttcccaccggtcctgatggcaaacctgtttcgccatatggctatccagctcctggttccgcccctatgcctctagcgatgcctcccgcagctggtgcatcgccaattccccaggccatgtatgctcctcctgcgattgatttcacccattcgtttagaggcaatcctggaaccagcaatcctggaaccagcaatcctggggcgagcaatgcccctgctactccggttcctcgcagcgaggcaaattcgcctgccagtggagagaagcgaagcgcgtctccttcctaccaggactctctgcgtaagaagcagtcgcttgacctatcaatccactcgctactgaacaccaatagtggagaggagagcactcggcagaaactcaaggattttctagacattcaaatccccgacaatctgaccagtcctgcggagattcgggaatatctgaaggaaaagcagagggagatcagtgagagactgaaggatttgaactaggatgcgtccagtttgacagcctcgctccccaaaagaaagcagttttctaaaaaaaacagcatacagtgagtacttctttaccgtgcccacttgcgattgccaatttatacagcataattgtctgtacctggacatgtgcaacccccaaaataattagagcgtacagtactaacggttcaatgtatattatttatgactttacagggtgtgcgtaaactacaatgtgatgttatcgtagcattggctggaggtgtgttggtgatgtaaccgcttcgacgtgacgctgccagatatagtcgtatttcaaatgaggagagttgagaacatggaaaggagacgtagatgccaaggttgaagttggtacaggtagacaggaatccggcaagagaatgagggacaccctcagttgtgacaatggcaccaggagcaatgcagctcaatcatatgcccagggttattggtaagttggtttgtagttggagatgtcatttcggaagagtaagtgactaaggttcccagtatagaactactgtacccgcgggctgtctcaatactgtacgcctacagtagttaccgaacgagtagctacactgtggttcatagcgtcgtattgtagagttacagtagatgtagatgttgtgccttgcaggtgagtgcatgtcgatacagcaagtgtctatgctaatatactgctgacacctcggcaaacgagatattattttgtcgacgatgtcccagcctcggcattctgggccagtatattatagaagacgttggagctgcctcggtgacagctagaattccagtacaaacctgaaatttggcctggcatctcccatgtcaaactgatattatgaactacagcatttagcggtatcagatggatcgctacaagtagtgagtttgttacaagccgacgtcagagaagcagggtcaatgtacaagtcgcataggtacagacaattgaggcctacagcagagcaggtagatgtcggtacagaaatctacctgccgtgaaatgattggttacagattgtcatcctgttcaggtgcttttgtcgcatcttcttgcttcggttcagacaaagcgtgcggctagagggctaattttgttcataatattgtggactgggctattccagagaccattattaagtcacgtaaatgggttctctagaagtaggagttcattgaccctcccaagctgttgtaccaagacatcaggaagaccggcgaggacgcgagaagtgtcttgtgagactaagggatttatcagccattcctcgaggcaactgttgcaagatagtaggaattgacttagctccaaaataaccggctatagttgtcccaccatccctgcggcttgtaccgtcgtccccacattatcccctgtcggttagtgtttcatttcgcctatttataatatgttagaatatttgactggtggtactgtagatgtacagtagacatcttctggtggataattttctggtgagggcccgtgaattgacaatgtgagtgttttggttactgtgaggtccatatggaggttagacaaagggttgtgcaacaaacgatcccattttaaaccataagagaggtttttgatggtaggcagctcattgatcagcaacaaatacttgtacggtgggccttgagggcttaaaagtacatgaaacggtgtccatggcggtatcgcatatacagtagattgtaggaacggctcatgtgagcagatccgacagtcttagaatcgatatacaattgagcccatagcgcagtcgccgtggaaaaacagctactatagctggcactaaaagtgtcatgtccgagcaagcagagagatgaatcacaactcttggaagagatgcaactgtgagcacaacgtcgggaactcagtgagttatagatgagttacatagaaggcacaattgaaatgtatctcctacaggcaagttgtaaacacctagcacggttcacaatcagcgcatttctcaatctatctactacctgtacctgtgtctgagaaccacctcatgtcagatgtcaagttgatactaccagtactgtagacctcttttcagcccaccccaaatagggttgacggtgacagcaagccgcgcgctgatcctcgaggtagaaatgttctaatattttgcccctcaaacagccgcttcctcgcaggatatctgcccaggtagcttgatttgtcctctctaaccgaacttccccatttcgtgcctttattatccgtatttctcatcacaagatgtctctattcgcccgctctgtgctacagtagtattacgtaagtttgacagggctatgagtctactgtgagaaaaactcacctgatgatgtttcctgaacacacggaaaagctttggaatagaggagagatgtcggtcaaaatgttacaagctcatggtatctgagaaatttgtctctcgatcatcttctcttccccatcttttgaacacaaagagtgcaaaaatgaccaccactaggcagaatccagaagcctgttattacaaaagtctattttattgatctaaactcaaacacgcggtaagtctcaaccttatcaaatacagtaggggcctatgtgcccacacatatatcggagctgtcttctccacattgaagattctctcttacacttgatcgtattgcctcgaaacatgaccaaaacggcggtcccacgaaaacgctttctgtggcaccctgccgacatcgacacctactactcggatgactatttttctgacgaagagcgtgatttcaaatatggccgaccccgacccacccccatggcatctctccttaatctcaacctgaacgagtatgagctcattcgcttctacaataacgaatccacgccactgttggtggctgccacaggcaaaaacgaagatgcccaggggctctggatggcgaatgtcacgaaactagcatccagtaataacgctctgaaggaaatttgtatggccttcgccactatgcatatgggacacaatcgaaagaagtctatctacattctcaaggacggaagggagcacccaaagacagcaggccctctaacagacctgacaagagtggcgggatacacacgattggaagaagaggtgctggagcagatgttcatcagactcacaaatgcagtcaaggcccatcagctgcaaatagttaacatgacactggagtcatacgagtcggtgttgctctcaagcgtgctcatttacctgcatgccatgagcatgggtccatttgtgcctctcttcagctttgatggcggagtcgacctgttcagtctaggacgaaccatccacgatctcacatttatctacagtgataaaatcgagccttcgaatccgttcaactacagctttggtgaggactcggaaaacgaccgcgagaaactgccacgggaagaagatatgtgggcaataatcgattttgtggacacagatgtggagctgagtgtggcagagaagcgaaggatcaaacggtcactgacagctgagctcaataacctaatcatgctctttcatatggaccgcgaggctctgtctgtgtcccacatctcagcatggtgcacgttttggaccccgagcttctttaggctgctacgcgaggagcacaacacatatgcgctgttgtttgtgtgttattggtgtggatatgcacacatgtggcatattctgttctggtggggtgatcggatccaagaggacttattgaatttgaaggatcacctgccagaacgtgtacatcatttcctagagtggccactccagagttgcactcggttcgacatcaactatgtcgacttgctaaacggcaagatgcggcagttgtacatctagtcactttgttgagctaggctcagatgtcgctgatagtatttaatttattggagattttcctctctctgcacaaggggaggaagttacggttatcagtgcattcacatgcataatattgtattattattatacagctgggagcaagggccgtgcgacaacaactaaaaggcgaagttgagacaattgatgtaggccattctgatgacaagacgtgtacttgtgactttgtttcacacacttggaatggaataaaaagttagtcataaggtgtcgacagccaagcggcaaacgaagaagctgcatattgtggggtacagtacataccactcagctgtaaaactggcaacatgccaacactatacttggaactgagccacaagtttatataagctatatatagcatacagtatgtctagcatatttatatctcttttactcgcaccactatgtaaatttcttcattctcaagcttgaacctacatacataacttcaggtagactacgttatcagcattgggggtaagtcatgaatcatcattctatggaagctatatgataatctaaggggcgatgaagtctcgtccaaacagacctcgcttgagccaatcctgaaacataagagctcgggttcggaaagaaacacactgcgaaaagtaggcagatcgccagatgtacatgcccagaagacctccggtgaaggttccgtgcttgccgaaatcgaatacagcggcattaccgaggtaggccaggtttccgaggtgcttgtacttgaaaggcttgtagtaggcggcgtcaatgtctccgtagggaacaggtgtgtcgtaggcagcagctccgatagaggcaatctttcggagcttctttccgagatagacaccctgctggttagctcgctgggcagtggcgggcaaagatgtgatcttctggtccacgtctttgagcatcttggtgagttccgagtaggaaagagttccgctgtgatcggcatcatactcctggaacagctcatcaattctgacaaaatgctcggaagagtcgggcagagtcttctgcagaacagcagtcagtcgcttaacttctccaacggtcaatttgatctcgtgaactcgcttttcgagtgcctcgggagtctcctgagtgttggcagagaagggtcgagaagcaagaacgtgggactttagaatatctagagccgtgtcgagaacatgtgttcgaacagtagagcagtcaccaatagcgtaggcctgtccctccggggttccgagaattcgcagctgagggtcggtctcaatggctcgtctgttggtctggttgggagctccaatgtccttaacaatggacttagtaagaggagattgatcaacaccggtggaccacagacagagaccgaagggcacctccttgatgatcttcttggaggggtccttggggtcagcctgggagaatagcactcggtcctccttgacctcaacaactcgcgaattgatcagaagatcgatgttgtcgtgcttgaatcgctccatcgcgtactcggagacggaatggtcaaaggtgttaaggatggcagatcgagactggatgacgtggacagagacaaggtttcgcagggccttggggtagtgcttggccagatcctcgttcatcagatcgtagacctcggcagccatctccactccagtgggtcctcctccacagacaacaaacgaaagcagacgctttcgctcatcgatagaagtagaggggagagcggccttttcaaggttggcaaccaactggtttcggatactcttcgagtcgtcaacggtcttgaggaagtgacagtattgcaggcccttgactccgtgggtattggtagtgcatccaacaccgacaacgaccttatcgtagggaacatagaagttgacagtgtctccggtcactgggtctctctgggaacactcaataagacgctccttgaagtcaatgttgttggcagaggcgttgacaaagtgagcagcagccgcagcacagattcgtcgcacgggttcagtgatagatcgcagctcgagagtgccaacggtggcagagggaagcatgggggtgaacaggaagtagtttgagggagaaatgagagtcacgttgtaatcgccgggtttgagggcattgagcagagctacagatccccagccggagcccagaaccaccagacgaggcttgctggagctttcagctttttccggagtgtcggtatcatccagccacgagtcgaaaatgggtaggttcttgggtcctcctcttctaggtgacagggcaagagcatgaacgtcaatgtcaccacagtcatcaatctccttataagaggaaatgtcgtaaaccaggaaggagacaaccagagcggtagctcccaggccaatggctccaaaagtagcaaggctgaatttgaggaactttttgcctcgcgacagcggggtgtgtgtctgaagcgcgggtcgagagcaatgcagtgatctgaaggccgttcggacagctgctggtcgagtcagtgagctcagggctcctgcacgtgtcaatggtcgcaacatgttgtggatgatgcagaaggagtacaagtgcgagtacaagtacaagtaacaagtatcgttatgcacgataagtttaagcgagtgtaaggatccaatgtagcaagtagagacatgtctcaagaagtggttgaaggacgcaattggtggccgatttgaatttggtaaaaaccattgggatcagcgcggggaggcgagttaagcccaggtttcggcgagctcttagcgttgtatctcgccattctacacaccctctaacacgaaacattaaggtataagcgaggttcctcggttgctgtcatattttgtatacacaagctctctgggtctcgtcatggcggattatccatcacatccactgccactcccatcctacccggcataatcaaagcgagactagtaactcactaagtagcactttcggtatatcgcgcaggttgcgaatatgccgcagcttaaccccgaacaatgattaattgaaagcttaaaaatcaattacggagataaacaggcaggtggagatgaggactccaaacggcttgagcacgcgctgtgggctcatttcggagataatcccacctgcttggagtggaccgcggttggtccaactgaaaaataacaaaaccaacaaaagacccaacattgggctacttgtagctcaatagccccatgtgctgtagagtgcaaccagtaggtggtgtgtatgtactatacatagcaaagtgacaggtggcgagcgttatagtacgctctcacagatggcatatcgagtccaggcccgttagggaaaattttgttgcacaattgacccaaagctattgtcgcaccccatctctcgaatcctccgacataagaaatccgtctttttgacatctccgtccgtatagcctatcttgtcgaagccctaaccccttcttggcatagtggtgcatactaacttatagcccagcctcctccacatcataaccactcactcatacgactactcgtactcccttacacatcatgggtatcaacaatcctgttcctcggtcgctacgaagcgagtgtcgtaaggctgccaagattcttgcttcttttgtcaagcccaaccagattttcggccaggacatggtcattccgccccatgttcttcagaacgccgagggtcttgtcattctgaccgtgctcaaggccggtttcctcttttcgggccgagctggctctggagtcatcgtttctcgacttcccgacggaggctggtctgctccttctgctctggtcacagctggtgccggagttggaggccagattggagccgagctcacggacttcgtcttcattcttaactccagaaaggccgttgactccttctcgcagaccggaaacatcacacttggaggaaacatgtctctggctgccggacctcttggtcgaaatgccgaggccgccggttctgcttccgccacgaatgtggccaccatcttcgcctactccaagactaagggtctgttcgctggagtgtcgctggagggctccgtgctggtggagcgacgggaggccaaccgaaagttctacggcaacaacaatgccactgccaagaagattctcagtggttacgtcgagcccccgccagactgtgacgctctgttccgagtgctcgagtcccgagcgttccgaaaccccaacgactttgccgacgacgactcgtacttccgacacgacggcgactcgttctacgatgatatcccctcccagttctcggacggatcatctgtgcgacgaggaggagacagcgacgacgagtatggaggacgaggcggaggagctgcagcaggccggttctcgtcacgaaacagagatgacgaccgaagaggaggctcgcgacgagactcgtcgtactcattccgaagcggccgggaccgagacgatgatcgtgaagtggaaagcattacggaccggtttcgcaagacacacttcaagtcgtcgtactcggatgacccctctggccgaagaggctcgactcggggcaacaacgatgaccgatatgatcgggaccgagactggagagacaagggctcttctcggggcgaccggggcgaccggggcgaccggggcgaccggggaagccattactcgtcccgatctcgagaccacgaaaacggcagcagtcgatccaaccgagacagagaatatgatcgggatgacagatacgaccgagatgatcgggaccgagaccggggagaccgatacgaccgatacgatcgggacgagaaggtggaccgatacgagcgacaaaagtcgcctcgagaaaagccgttcaagccggctcctccccctcctcatgctcctgttgcagccgccgaagagaaggctgtagctctttacacttttgatggagagcagcccggtgatctgtctttccgaaagggtgacgtcattgccgtggtcaagcggggtgtgtccaaggacgattggtggacaggccgaaacggcgccaccgagggcattttccctgccaactacgttgaattgatgtaatcagtcagttcttagttcccattacccccaccgccctcttctagttctgatgttgacattttctgccatcgctgatacggttttaatctgtgatatagtctgtctttttgtaatgatatgataatgatattgacccagcacctgtagtggagtcaattgatctctgggccatgactcaaatcactcatctggagcggctaatcggttgactgcctaatctgaaataacgtttccaatacctcctcaggtttggtcccttgaaaatgggtgtttaagcataatgattgtggttaacgattctcgtgaaggcatcttcgagaagtagtgggtgaatccaagctttctcaaattattcttagccttactgacaggtctactgctggcgatccggtttacttcaatcaccaactaattatagttagctcttccacttgggacaaaaatacattttcaaatcaaagttgaggttgaaagatcggcaggtcgagattggtgagcgattatgaggtgtgttccactgacgttcccagagcaagttctgtgggccgccataaaactggcctttgtacagtgctacgtgtcttcatctctaggacctgcagattagcaccatttttagcgtatcttctggggtggcgtcggggcagtgtttgagtcttaactccgataattccgtgccggatacatgatacatgatgcgttctttcttcaactttatgcgagtgagtgacgtcatggaaagacgggcatttcagcttagtaagcacgttcgggggaaatgcggagtagaaaatggaagaaacaagaaattgatgaaaaccacttttgaggatgattcccaacgatcccggaaaaacggaaaatctgcaaacttttcaaaaaacaccgttaaaactttccaatggctccaatggcttcccaaataaagacagaggtaaatccaccgtattagtcaccttaccctcgttctatcgagcccaaacacggcccatttagcttaggatcatggccgattgtgcggtacaggggaaaatattttccatactcacatccctacaactctaatgacccggcatgacgaacttggtaatcgatccggataataaagaggaaagatcaggagaatgaggacagtgaaattagtggtatgtgcggggtacaagggtcatttgcggatgctagaggagcgtggggtattccgattggctcgattgacccgtttcacgccccgatcaagcacttgttccacatgtttctatactctgcgtctgcggagacgtcattttgcatgtctgaagtgggtttggggtttgtatggctgtcgagtaaagagcgcatggagatttttgtaaaattctagaaaaaatacttgtagtttcctcgctcatcatagttatcatcctggactctcacgttccacccccccacgctcactactagcacttgctgtagtcccctctctcgtctatctaccgccctaatgccgactgcactatgcgatgtccagataaggtagcaatccacacttctaggtttgtgaggtggtgttgaggtaccgacttgattgagacgactgaaaggacctccagctacatctaaaatcccagaggacgtgcgaagaaggtctttaagcccctttgtcttctagcgaccaaacccaacccgtcaaggcgacatacatcacgtcgacctcgtcccattgctgaacctaaacccacgcactccttgtataacaggacgtggtcaactcaactctctcttgtacacatacaccacaacacacacaaaatcaatcatgtccaactccgccaaagccgctgtcgtgccccccgcccccaccgccgaagatatcgcccgagccaacgccggatccaaggaagagcccgttttccaggctaagaactttctgtccaagttccgactcgatggcaaggtagccattgtgactggtggagctcgaggactcggattctccatggccgagggtctgtgttcggtcggcctcaagggcattgccattctggatgtgcagcaggacctgggtctggatgccattgagaagctgcacaaggcctacggagtgcaggcccagttctacaaggccgacgtccgagacgaggagtccgtcaacgagatcatcgaccgagttgtgcacgatctcgggtccgtcgacgttgtggtcaactccgccggtgttgctgaccttgttcacgcagctgagtaccccgcagacaagttccgacgagtcatcgacatcaaccttaacggatccttcttggtgacccaggccgccgcccgacacatgatcaagcagggcaccggcggaaccgtggtgttcatcgcctccatgtccggatccattgtcaactggccccagcctcagagcgcttacaacgcctccaaggctgccgtcaagcacctgtctaagtcgctggccgccgagtgggccgtccacaacatccgatgcaactccatctcgcctggatacatggataccgctcttaaccgagcctacaacactctgtttgaggagtggaaggaccgaacccccctcggccgactcggagaccccgacgagctcaccggcgcctgcatctacctggcttccgatgcctcttcgtacgtgaccggatccgacattatcattgatggtggttacactattatttaagcaaccacatgcgtagcttgtggttgtagactcgttgaagctgacgcgatccgacgcgattgtctcagaggaatgggtaaaagacgaataaattaaatctattgtattttactgaacgcgacatgtaccgtatatgctaagtagtagctgctgtgtaatggaaccgtacgctaaagtatcgatgcgccaagctggtacacgtgcaccggttgcgatctgagtgtgtgttgtttccgtggtaacgggtgtgaaaagggagcgtggttggaaatgggaatggggtttgataatttgtttgtgactgttgtgtggatttgtatcgagtgtttatgatcgatgacgttggtaaggggtatcgagaggagccagaattggacgtggcaaactatttgacaaacggacgcatgggaacggaacagagtgttgagtgtcgagtacaataattgagatgtagagctgaaagtgtttcagcttatcagcatctgttgtcgtggtagtttcctgattacaatgtatgtacggtaggtgatccccagtcgtgctacagcgtcacgatcgatggggcgcaacaccacacactagatcctaaagctcgtgagcatggatgtagtttctggagttggaatttcgcaatcccttttgcccaaacagatctcaactacagtcgcagctagtgagtgtgtgctattggcctgctgagtggcgtaaggagacgtcatgaaaagtcctcatattgaagcagtttaggggtgatcagggcagtcgagaagataaatgtgacaagcttggatgtatcaacttcatgattaactgttggggacagccactcgaatgtggaagttgctaatggactcactcgactcaggcagatgacattatgatagaaagtggggtagtttcagttggatgcactaccaagagagcattatgttctataagtggtgcttgcgaaacattccgtaaactccacggaagttctcagactttcaatgagtctatatctcaacttctccggtcccgatatcttgtttttgtattgaggtacaggtatcgcacaaaggcggttcctcggcaatacggggaacgtcattgacgcaaccatgggtcccatgcaatgcattagcagcaataacgcgccggtgggtgtcggtttatgagcacagggcggttcacgtttactgcatgatgatctatggggtgacggtgaatctgtatctgctctgaacgaacgtcggtgatagtctcagccgccctgtactacaaccagtgctgtgaacttccaattatctatagaaaatgcagattgttcatttcgcataagaacgaatacttgtacttgtctgactcattatgtaaaaaacaaaggatccttcctttctgggatgtccccaagggaggagggggggtggctggtgaccctggtgaggggctggcattgccacaggggacctggatcatctctggaacgtttattcgactttcagagcagctccaaatcgtagcacaggacctttctccttctattttattcgggattttgtcccgtgcccctgcatagttgaatagacggcactactttcagcacttgataattagagtcaagctgacggcggggagacttttgagaatgttactgtaagttgatgcggagacgacaggtgagagttattcttcattttgagagtgtacttcaactcgttgatggttcgttgcttgcatttcatgggcagaaaccatagacattccagtaagatagattgacagctcacctaaaggcaacactcaagttgtagtctcttgttggttcaaaagcgagctttagatcctgggcatcagcagccagtgttcgttcttttttttgggggggtcacaatatcacactctgtacttgtcatgcacgaacggaaatgctggtgactcggatcatcggaaaggtcagcgtgaatccccagcgaaggtaaagaagttgaattaaagggagacaaagaaataccacaatttagtatcatagcatctaactatgcctaacatataccacgtgactcttatacttggtttgtagctctcctgattctctcaccatatatattgctgatcagttaatccgaaagactatccgtgtttttccgaatgatccgattttccgaagagtggacgtttttggtctccgtaacggcccgaacatacaccaggcatgcctctcagtctttgtgtataattttgttccactgtttcccttccttttcccttcttttacatcggctcgggccacggcgcagattccatgcaaaataagaagccgaacttagaagacaccaagatgatatctaggagatggaaggtggacgtggagaagaagcagggacaagaccaataccccgccgcatcctgtattttattttctctccccctgcacgcctcatctcatctacatgagaagactgtatgatagcgcggtaggtctcgctaagagtgcatgttttttgcgtagagttttttacaccttatgatgttagagttagggccttgttgtgcacctacaaagcggcaaagcggcataccacggtgggtttggtggaataccgttttacaggtgttgaggaccttttggcggggttaagctgtgcagagaggagccccgtaccgcactcctccattgcaatacatgcaggtatatttttttgtgccacgactgaacacgaccttgtctcatagaaagcggctactgacgctatttaatgcgctagtgtcaaccactagtgccaaggctcgtttacatactgaactcgtactataccagtcgaactcatcgcgccatatccccgacccctcaaatgcaagttaaagtcttttgctggttggaaaaagtgctcgtttcacctgcacagcttcccctccgtctccccttcctcccatgggaccattttcctcttggcatcggaaaaacagccgtgtgtttgctcgtccaaccttgtatgcgagcttgtggagagagcgaaagtgagggtggataataaacgtcttgatcgtcgtttgtaaggatgatacgagtgccagacaaacggacaaccacctgtacacctgccacaccgcagacctttgcctctccctcctctcctcgaggacccacctgggcccacaagctgtacctccacatgcatgcattgctatcaacaacttgctaccgagaccggaacgttggtgacgtacaaaaaaaaacaccaaaatcaaacaaacagagttgccaccgcatgttacgcaacacaagcatggcatggggaacggcagccggaggttggaaacgtcgacgagaaccgtggcctaacaggaatgacaacggtgtagctgcctattccggctactgcagtagtagtcccgcaggtccttgtctttgcacaggcacgtatcatagctcagaagacggtcttcgcaaccgccctctcatccatcgtagcatcttccccgctgtcagcctcgtcaatgccggaaaatcaccccctgtctgactgcaccgcgccttttgcactcgaatgcactcccggacaattccctcagcactgtctcacttgagtaacgtcggcaaacgcaatccttaacaaggtgcaatgtaaccgaggaagttgggaataatagttgagaatgtatccgactacgagtggaagatcgtgtgccggtgaatgccttctcgaaaacaacacaagatcaagctatcagacgaccaccactgtatttttctcctgtcctcgaaacccgtttccccacctcatcgacaacacattgctaaatcataaatagccgtataacattcaagcctctctttatatataccgtctgcaaagtctacttttttttctcgtcaccctcatcggccatctctccctcttttctctctcttcatctcttccccacactcttcatccagatgctcaaccagccgaaaaaacccctgtggccgaaagtcagacacttcttgcgagaaccgtttgccgagttctggggctgcgtcattctcatcgttctgggagacggttctgttgcccaggtcactctctccaacggcgagaagggagactaccagtccatttcgtggggctggggtctgggagtaatgtttggcgtctacgtcagcggaggtatctctggaggccatctcaaccccgccgtcacgcttgcttcttgcgtctacagaggcttcccatggagaaaattccccggatacatgctggcccagaccctaggatgtatggtaggtgctgccatcatctacggaaactaccgatctgcaatcgatacgtttgagggctgcaagggctgtcgaactgtgtctggtcccaaatccacagccggagtattctgtacctaccctgctcccttcatgactcgaactggccagttcttttccgaaattgtagcctcggctgttctgcagtttatcattttcgctattaacgacaccaaaaacatacccgctggtcctctggctcccctggtactcttcttcctcattttcgctattggagcctgtcttggatgggagactggatatgccattaactttgcacgagactttggtccccgacttgtgactgccatgatcggatacggcagcgaagtctggagcgctggaggttactacttttgggtccccatcgttgcccccttcattgggtgtctgctgggcggctttctctacgactttttcatgtacaccggggacgaatcgcccatcaactggccctggatgggattcgaccgatttctcaacccccacaagcgaatcgaacatgatatgggaactgttcagcagaacgtggaggctcccatgcttgtggaagcccaccccaacatgggctcagtgcaggagaaccctctgtcgacgggaaccgacgaacccaaggtcgatatggaccctggcttctcgtcagatagccagactgtgcatctgggcagaaatatgcgagccgctgaccatgaacatgtcgagcaggctcacacgcctgagtcggccactcctccccagcctacaggcgccgcccagtttctggagttcgaaaacctcgacgactcggacagtagttagggatatttattagcatgcacatcagcatgatttacgacatatttaattgcatacagacttttcattgctgcgagtgtgacaggcctgagagtatcagttggagagcgcacccgcaccccacgaaccaatcgccaagcacgttatataacagagaccccggtattccatagccgaagatactgtacgacatcagcctacgcctttactatgtggtttggtgacctcataggtttggtgacctcatagatactgtagctcgacagcggcttaacagtgcggaaacctgtctgaactatcttactcttgttgcaatagacaagttacaagcaggagttgtatattctctctgataagggcttgttcatcaaaacagtatatattgacagactttcgaaacttctcttatttcacaggcctcagtatcaggtagagtatgtactggtacttgtagattgttctgccattgccgcacatggtggatatattagctcagacatgaagatacgagttgagtaatttaatgaataatatatccgaggtgtgaacaatgatgtcatggttgtctctaaccatccaagtacatacggcacaggcataaaacaatataagcctgtggattgttaggcagcctgttatggctgtgaacgactgctatggcggcgctgtacatgtatatgcggtatgtacagcagagtcaagtacaagtaccgataaaaatattggtatttccatgttgatgaagtccatgttgatgatgacctggaatcgaaagacttttttagacaccttgtgcccaaagaccgacatgctgtggtattacatcctgtcgtaagctggaatctttcgtaacttaattatttgtactgtaattaccaggagaacaccctaattattgtcatacatgctatatagtgtgacagtaggcaactcccatgacgctacactagcagaggcgctgagcgtagtaatgaaatgcctttcgtgtaaaccaagctttcatcttcaaagactcgtgcactcctgatagagataatcgatttgttcgcgcttggcagcttcgcacatccatttgctccgcttgcatctcttacagaaactgcaaccagaagtaaatgtagtagtgcagcttggaatgcgacttgaggtcaatcttgtagaagtcgtacgaatcagggtggttccagtccagaggctggaaggtaggatccgactcgatcattcgcacgtacttgtcgttcagatcagctggcagaaactccgactggttgggaaactcggggaccttgtggtacaggtaccaggcgacagccacgtatccacagggctccaaaaggaagacaggggtgggccacacaccgagggccagaatgaaactccagaagaactcgtagccccaggtgatcacaaaggcggcccactgggtgtagatgaacactcgcaagtactcagtctgggggaaccagccggagatgaagtacacctgggaccacttgatttcgttcagcagaagcgaaataaagagacggaagaagagaatgatgacccagtggtaggcaaacaccttttcgagccagttgagaccgcaggcaagacacagaatgatagccacaaacttttggggaggcactcccatggcattgagcttagcagaggagattttgggggtggtccagaagggtgcgatggaggtagcaatcagcaagagcaggaagaagaagcccgaaatggtcacgtttccgtcctccatgtcttcgtcggggagtcgaccgtcgtgcagtcggaaaagaaccatggagtgggacagagaaaagtccttgatccaacacatggccaaattgataccaatggccggaagaagtgcctttcgaagacggtcatagataagagcagcttcgtatcggttgactcctccatatcctgctgacgtgtcttcattctgaatatcgtcaacagccgcctgaattgacgattgaaggcctcccagagcggaatcattgttgttgttgctgctggaggtagtgttggtagtggtgtcgttagtgtctgtgtatgcgctggtgtttgtgtccttgccggctcctcgtccctcgaccaccagctcgtcgctgcttcggggagactcgtcctcaatggcaatctggttgtcttttgccatcttgtgtcgtgtccaaatgtgtcgtgtacgtggttgaaagtacaaagtgcaaccaagctaagctcgtgtgttggcgatacgagtggtgaacgtgccggaagtttattaggtggcgctgcggtgtgaacaggaatacaagaggtaacaagacagagatgcagggtaaacaagacctatatatacctgtgcgagtgacacaaaaacgactaattctagccagttacacaaaaacctcgctcaacactctgtagctcacacgtccaagcaactcttcttctccatatcatctcccttgcagttcgctagtggcgacggtgcatgtgatgcaggacaagtgctcacgtgacgattggaaggtggttggatatatatctcacacgaggaaaatacattgcaccagtcacgtgaactccgagttcgtatttattgtagtcctcgtacgcattcaaactcgtcgttttactcgagaatctacatgtgctcattgtacccgttccgtttcggcggcggttgcgatcaaccccaaccctaatgttcctatttggcagtaatagccgtgatatctcgattgagtaaccctagccctatctactcaatgtttggcagactctattccctgagctctaaataagacaactagtcaaatcttatatttcaaaacgagtaatttcctaacccttagagttccaatgttactataggagaactcatgagacgaaatttcggacgtttttgtcaatattctgttaatattcaaccactcagcgacgtgtaagattatacataatgtagatatccatagatcgctactttttctgatcattttgcgtcgcttttaggcatttaaccgcaagcaaacatcagcagaccccctgctattgatcttgcatctttctgcggagtagattgaaagattttttagataatcacatgaatctaatgtgttgatgggttgaatgtgtttttaccagaaggaggatttgatgtgttatttggacggtgtcatgagggactattgttgattgtggatgaagtttggttcggtgaagaaattgatggaggaaaaccccccgtagaagtggagtgacatagtcagtctgccatctctttcccctttgctctgaacgtttcccctcttggtttagcagtgttgcgagagtgtgcggcacaaactgctgtgttttagtagcaggcttagtccttatcggatcgtcctactgtatctacttgtagctacatccatccaccggtatttatatattcagcggtttctatcggttggaaacattttccgaatgtgtcaaataaaacgtgacttctgacctctctaaatgctcttagtcagttactttctgtccttcagattggatcatatctgatgcggttgcatggtgagtcttggcaaccttactgggtggtcttatatagacccaacggtaagacatgacattgcacgatactagtacagatatccaacaatatgaagtacactgctctcgctctggctgccacggccgcggctctcccgctcaacctgcagcagctcactctttcccccaccaacatgatcgaccaggtggtgggtcttctccccaactccatcaagcagtctgtgtccggcaagaagatcggtgacacctttgaccagtccggtatgccccccaaggaggaggctgcacgagtagcccgaactctggttcaccgggagtctctcaccactcttgtgaccgtcaacaaggacaatgttcctgaaggttacgttgagtactacgccgattgcggcaaggacggaaaccctgtgatgctcaatgtccatattggaaccggattccgaaacattgccgctggctccgaggccactctttcggtccgagtcggtgaccaccccgtcactgagaacaccaacccctggtaccctggaggaatcgtcaagtccaccgctggctctcctcgagtctcccttcgaggcaagttcgaggatatcgacaaagacgagattgaggccgtcgagtcgtgcttcctgaagcgacaccccgacgccaagtggtggttgcccggtaacaacgtccactccacccactgggtcaagttcaacgtcgactctttgcacatggttggtggttttggcgaccgagccttcattggtgagatccccggtgacgtttaccgagaggccaagctgcttggccacggagagggagtcaccctctctgaggaggagctctttgctgcccaccacggcggtatgtccaaggaggagtttgtcaaggtgcacggtgatgttaagcaccacgacatgaagggcaagcaccataagggagagcacaagggcaagcaccataagggacagcacaagggcaagcaccacggtgacatgaagctcacccaggagcagcttgtcaaggtccatgccgctctgtctgacgaccccgaggctttcatcaaggcccactctggtgatgtgtctatctccgacgagaaggtccacaaggttgacgccaaccatggcaaggatctgactgaggagcagctcatgaagattcatgctgctctgtctgacgaccctgaggccttcaaggtccaccataaccttctgtaggtggtgactcaaggattgaataactaacgactccaacagtctgtaatgaatgatgataactcttatgtgtgacaagtcagagcaaaacaatgacttggaactgtggaaccagtacaagtagtgtatatcgtcgtgtatacttctaattcatgatgtaagaatgcgtaatgactataacacgtacgagtaagagctacagattcctacatttctacaagcacttgtagtgccagtacacgatgaccctgtacaagtaaactgacatctgagattactttttgtaaggtcgtacttgtatatataaatgttcttataaaactacgaccaattaccaattaacggaaataattgtacatacttgtacatacagtacataccatggcggtgagaggtatggcggagagtggctctgttgctgcagtatccaacggtatagaggttctcgttttactgaacagttatacgaaagcaaaaggcacacatggttggctccaggtgctcattttttcttctcgtatgatggcagaccgacttggctgagggagattttgagagaacaaacgccacggtttacacgcccgtgatccaccacacaatatgaagctcgacatggtctctacctgttttcgagtgtgtgggtgtgttgaactcggagagtgtacgacacaagcgattatcattttgtcgagtgcacttaacaggaatttatacccaagtcctctgctagttaccacctgttatccctactgtcttctatgtcgctggtgaaggtctaaacgacatttctatcacgagttttttttttgttgtttttttgttgttgtttttccacctctcaactaatctgcattgatgatgcttgatatctcaactaatgtcaactaattgaatcaagttaaatatggatgctctatagtgacagctgaactacagatgataacagaatcggggatcaaacaccaaaaaaaaaaaagagcgaccaatttttttctcggtgcttgtttttcaatgtcactatactacgagtacatactgtagctacagaatagtatacgaaggttcttttttttctcatcgcgacgtccgccaaagcatttgtaactaagtccgtcatgtccgtcagcgctgcggaattaatgataacaacatcatattaggctttaggtagatggaatcggtagatatcacaatgatcatatgctttcccttttctccgctagcaaaataccatttttctacaattttcatcctccgtcaagtccgtctgcttctatccaacttctagaaggtggcgttatgcataatctcgctgctcttgtatataagccgtgcgacacccccacaaatgatgatacacaaacactaccatcatgccttctctctctgaaatcaagcaattcaactccactcacacaccttctgtcaacaaggctgtgggtgtctttttcggcggaacttcgggaattggaaaagaaacagcctacatgtttgcgcagaagttcgacagacccactgtattcattgtgggccgaagtgaagaggctggaagccagattgtggcagatctgaaccgtctcaatgcaagggccacgttcataaagtccgatctgtcccaaatgaaggaggtgctccgagtctcggagattgttaaaaacgacacgtccaagatcaacctgttgtttctgtcccagggtattctgagcaccgctggacgaacagaaacggccgagggaattgacttgagaatggctcttaactactacgggcggtggctggcagtcaaggagctggcacctctagttcagaaggcatacaacgacggagacaaggacaatgcccgagtggtgtctgtactagcccctggaaacgagggcccctaccaggaaaatgatatcagctacgaaacaagttctctctggccaatcagaacaggcacatcacgcaattcacttctgcggcagtgttgcgattctccagaatttaccctgatctgtccttcatccatgccaatccaggctatgttgctaccggaatcacccgagaactgccctggtacgtgaggttcccctctactgttcttctcaagactccttgggcaatcacagctcaggactcgggtcagaagttcttctacatgggagcagccagtcctacattttcccatggcgcatttctgctgaactcctctgcagattcggtcatggagaagtcggttgcaaagggtacattgactgaagaacaccaggacaaaatttggacccattccgaggacgagttcaagctggccttgcagtgaacatagaagttgggacggactacaagtagggtatcgtggggtttttgcacgtataagatgtttactagtacgagaatgtacattacaatacaatgtacttgtaccaatagtgtgacactcataatagcaaaattacagccacactcgataatatacagacatcattcattgcatgtggtaacacactctcatcgcattgcgtttttttcaagtgtctacttctgtcgcttgtaaatcttggcgaggaaagcgttgagcacctccttcttgaagcctcggctctcgtcaacctgctcgatcttcttcttgatgtcgccaacaacctcctcctcgtagtcaaggtagtcctgctcaatcttcatgtcatcatacagtttcttgatgacgagctccttggacttgtccttgacgccgtagttgtcctcgaggatctgtcgctgctcgggggtggccttctgaagggctttgttaacgagccaggagcacttgttgtcctggatgtcggtgccgatcttaccaatgaactcggggtctccaaagttgtcaaggtagtcgtcctggacctggaagtactctccgagagggatcagcacatccatggcctgctgcaggtccttggggttggtaatgccggccacgtacatggctagaacaacgggcaggtagaaggagtagtaagcagtcttgtatcgcacaataaaggagtgcttgtccagagagaaccggttgagatcaacctcatcctcgggggcagtcagaagatccaccagctggcccagctcggtcttgaacgaaatgtcgtggaacagctcgacaaggtcaatgtagtacttctcctgtcggaaatgcttcttaagcagaatgtagatgccactctctagcatgaaagcatcgttgatggcaatcatgccgaccttgggcttgaggtaccagcagggctggcctcgtcgggtcttggactcatccataatgtcgtccgacacgaggaaaaacgcctgcagcagctcaatcagccagccgagcagcgcgagtcggtagtactcctcgtcatcgagctccttcttgccggtcagtagctggtaggtgtcgaccacagacaggcctcggttgagctttccacccacacagttgtactgaagtgagtcggaaaaccactgcacggcatcctggggcagaccctcgtctcgcagcagctgcaccagctcctcggagattcgggggaacacgctttcgaatttcgccttggacattgttgtttgtgtacttgtactcgtggatggaaggaggatgtgatgtgacgatctgatctgacgtggttgcgtaaggagggttaattgaattaaggttgcgagtagagcgagcagagcgactggccgtaggtcagaacccgacagccccgcgtgttcgccagggtcacgtgatttattgagaagacacgtgccatcgagatggtagcgccactgatatggtccagagccaggttcttgttatttgtgtggttgtactgtgtgtgtgtcgtaacccctgaatctgtctctttcctgtgtctgatacgagacatgtgagtgtacgatacagtatgtacgatgtgtgtaggtttttgggggtcaaacgtctcatatatatagctaggaaaagagtgtttggagcgctacaataaagacgtgtttcttaccctccgtaatgggcggatcctgtcactcagctacggcatttggttgtatttcaacgaagcagttgggttagggttaatggattgtagggagcggaagaggggataaatggggatcatatcattcaaatgagacgttagacattttagtaatcacaatagagcttttgaggagtattatgtgttcgcaacagctcaatcttgccatttcagtgttttgattgatttctcaaagttgaccaatcaaaaccctcaattaacatgactcaaaagagtcacgcatttttcatctagagaaatacagtttggacaatggcacttttcacaatgaggtatatcacgtgatggggagtgttagagaggtggggccatttttaacagatttcaaatggctcgttcagtatattttgtgactttggtctttctcagacttgtattggtgctgttcgatgatacgtgtagatgttccaccagaagtgagtcgttcaggagtgatgtacttatactatgtatgtactgtagttacagtagagagataatggacagtgttagtgaggttttgatatactccccaagcagtttatttcgagtggaaatattgtcacatcttggtgctccaataacactttctgtggctaaggcaatgactatcattacactggacgtacagtacatggtccgcaataactgatctgcttggatatccaggtttgaatgaggacttcatattctattacatgtatgattcaatttttctcactcttggcccaaagtacctacaattacttactgaagaactatttgagcaattgatagacgattcctagtacgggttgtctacagtatttcaatatgctctcaaaaagatctatatctcttttgtggtgaccatacttattgtaagatttatttacaacacacctgtttgattatcctacccgtacaatccgtatcaaaggcatctgctctatcattgaactccccgttttttattctgtatacccaagaggttgggtgtcttaagagattaacacattctctgtagactgtaggaagccatgagatttttttgatctcttgtacaagtctccaagttcccttttattggcacaacagaacatttcagtgatttccagaaacggagttggacacaccagacactcctgctgttgccatggaagagctagttgctccatttgcccacataaacactcgggagccttgtaaggggctttcgattagtctctagtgttttcctcttggggaagagccagtctggatcatcattccaggtcccatttgtatgtgttactgtagtcattctagtttccaattcagcaatatctagttgatcagaaaagaaacccggagtttagaggcgtttggtacgacaaacctcaccctggagtccagagagatgctccatattgggtatatcagggtctaaaccagcctaggagctgatatatccctctgggatgtgataacaagagcttctggcagtcagtttccatacgaccttcgagtcaacttcgaatatcgtttccacattgaagataccaagtgagaagaaagcctgcatcgttggctagttgaattgcaagatctagttgcggagaagaagtcgcagatatcagctgaagtctttcttctcttcttctgtagatcgccctctcgtgttctagagagttaaatatcttcaataattgcctggtgattatactgccggcaaacttgtttctcttggtggaatcggggtaatgtttatccagcccatgtctcaagttgtaggtattacggccaaagtggacctttgtgctaaagaagtacatacttataaagaccatacacttctcggatctggatttccgcgatatgtggattgttcgaaggaggacattcaatcaatcaagtcttacgacaagtatctaaagcaaatatgggaagaaaatagaaattcttttctcacataagtctcatttacaggagatagtaaagcaacttctgtttgtggtctggattccagtcggagatgaccccgagccgttcatagaagtaattacaacctacaggtcaagtttttggcgtcttatacctgttcctgtgtaccaggtgattcttactatttcaaattgacaactactttctgggagccttgaaaagtataccaaggggagtatttcttgcagttgatgaggtcacgttcctgtcattactactgtagcacctttttcgatgtcattgaaaaagaaagatcgactgtttgggaagaattgctcttctctcgagctcaaattcggatacttagtctcctaaaatggatagtagatcccttcaacacgcttctgttaactcttgcaccacacttccagaccctgtaacctctaatggcaattctaaagaaaccacaaagttaggaaaattgtttccaaggagttatgaatgtaagaaatttacttatgttggttcttttactacatctctgctctgctctactgtagagctttggagggaggactgagaacaactacaatcagtttgctttacagtggcctggaaagatgcaggttggcgtcttgtattgtaaaatgtttttctttacagtactgggtacttaggcgaccagagtagactgtatatgaagggaggatttccttgccttctgaggaacttgcagcctgagcgagagcgagttgttacaaggtctacaaatggtatcctttagcttgtattgtgatgatgtatcagccgtatggtagtttttaatcttgccctattgtttcatcaaagcgatgccagatgagtgcttcgatttcagttaaacatcttcatctgataccccacacttttcctcaagagatatctatcatataatacaattaatcagaaataacatgataaatcagaaataatacgaagtccaagtctgaaacgctcttactgtgttgctagtagcaacagtagtggaagtgttccccacctagatggacacttttcgactcatatcatgataatgtctatagtacaagtacaacaacgctgtatataattgtacacacaagtctctgtacaggtatctaactggaatgacaacatcttctgtgaacaagtttgagcgacccaacagtaaatctcttctcccggaagtgttctgcaagtgtaattgaacgatgtgtctactggctccgccaatacactttgtattccaggtacttcaatctctacaatccttccaatgaattctgtatgtgctcagcttgtgagcgttgagctctagtggctgtgcaagctgcctttgtatactcgcacaacgtattgagaggccctccgcaaaactaccgtaccgtactcggatacgagtgaatcagaaaatatctcaccacctacacatcaattgctgtcattctataatacatcctaaaccacctgattctagaaaacccaccatccggtcttcccggtggttcttggcacctcatgtacagatagaattacgagtgtttgttcttcaaaaatatgcacatatccaatgcctcaattaagtgacacggaatcatctgatgtttaagaacagctaaatattttccaagtacaagtacaattacagtctgtggaaaaaatatcgtggatatgagatgtagatgtcatgcaggtgtacaccaaccgcagtggttcctgcttgcgcccaaagatggcaatcaaaaatattatattctgttccagattgacgcacactctctgttcccccaaccacacggcctttgttcgatccgcatgacccgatgtacgtaaccgcctgccgctcttccttgccacctcacatcgcactacagcacattgcaccacctctacgtcttcgaggcaaccatccccaacagcactctacttgtagttaggtacagtacctaaactttttcctgtattgatgcatttcactccacaagcactttcaggtcatatcgtagagagaaggaggatgacttctcaaagaggccctcgtatcatttctgatagttcatcacatattaagatctcgtcgatctccaattatctccagcatcgtgtagaaaggcttttgcccagaaaatctccggttcatgtcccacaaatgtacggaagaaaacttaccattgtcgctttgtatatcctgttcgagaccgactttagagttaccatgcggctcgcactacaagtacagtacagtacttatagttacagcaaaaagaaacagatctgaatattcccagccgccccttcaaacccggctggcttcttgtttgggtatatctttcttctggtggataaatttgtcttgtgattacgcttgtacggagtgcttctggaatctgcatccctgtatgcaggttatatgtggacctgccctgcgctgcatcacagtgcgtcttcgtcgtattccctgtatgtttagagtttaagcagcagccggaagaggtaatggttgggacctaaacttcaatctatggagcgcagcaaaattaagacacacagataacatatggagactttcagatccacccagttagacaatgcgcgaaagacatggagaattttgccgctttcgtatcacctttgaggtggagaaacctacaagtaggccgcttctgtgtgttccagccaggttattaaataaaataaataaaaaacatagacaatgacagctggtcaatctcttctatgggatgagctgcttgtgtcaagagacaacaagaatgtacttgtaagtctgctgtcaggggtcatcggaaattgaacaatgggtgacatgtcgtatagctcaggtagttagtgcactttctaaataatactacttgtagcacgtacagccaatatcgcagtggtgtgcttcgactgcatatctacaagttctagtaactaatcaatacggtgggtgaagttggtgcaaacggggctcaattagtgagattattgccttcttagttctccacccaactccctggcctaatacccctcttgacttgtataaacagactctccgttgttcacaacctaccgcccatattagtggaaagtcaagaccgagttaataccactaccaagaatgaataaatcttatcgtgccggatcctttctgatacggtgccttttgttgggtagactacagtacagtacgccaggcgcgatctcaaatgagacaagagacttacttgtagcaagcgaagtaagggcgtaccttactcatgatactgtactcgtacttgtacgggtagcggcgagcaaattaagggacaagtgatgagtgttcgtattgtcttacatttttcttgtctcaaatcattcaataaatattatatacatcactccttgttatccgtccacatactcgatctaaggttagacggtaccgttgcggatggaaagaaagctgacaacgcaggatcatgaatgaaaatgtcctcatcgtcggttccgtactgctctgcagtctctgaatacttcttccgggctcccttcttagccagcttgtctgcaatgcgagctccagaatgcatatgttggctcctgatgaaccggagtgagatgttttggttctcgtacagcaacgctcgtagacgcttaatcaggtagtagtttggatgcgagcgcattctctcggtcggttccaggccctcccagccatgctccaaaagcctcaatgtccacagactgtctgtacgaatctcccatttttgtgaccggtaagtcatgtgtctggaaatgattcggatagccatcaccatagccaggatttcagctcgcccaggagtctgttcgccaggaacacgtccacatgcatcaggcataagccccttttcgaagtggacaccccagcctgcggctcctgcattgtatagaagaggtgaagggagggcattatgcgatccgtcagtgtacaccacatttgcttccacatcatcgtatcttccggcatggttggctgcaataggacccaattgtttggagagggagttgaacataattctccagttcgtttcaaacgctctcagcagtttgtggtcatgatggtctctgaaggacgttgtgttgatatcgaaatcggcctgcttgtgcttgaaggtgtggttggtccatcctgaatctccatgaagattcttgtatctgttagtagacagataaagctgtcgacgaggtatcagaggagctgccgcgctagagtctcggttacgcacaaagactggctctccacagttgcatgtgagccctgctagcatgtccagagtcacagtagttgagggatctgctgttcgagcaacgagctccatctttgtctcgtgtcgagcctttagcatctcccttcgcatctgtggagtcgcgtttttgaaatggccagtgagcgtaatcttagatgctggtttatgtttctctgcttcagagaacccgtcaagccagttttcaaaggtcgtctttttggcttggtttctaacagttccattctccttaatcccaatggcgacgtcgtcaggagcagcgatattctcagaaatcgacttgtccagagccttcaaagtcgctctctttgaatcccgtttctgtcgctgagtgagcttcttgtcaactgtatcttcagtccgttcggacagctcttgcgtggacgaaaagaagccctcggatgaagtatcaagtttaacagtatcgttctctaccgacgtttcattcttctggcgccactgggaaacctccgtggccgccaattcctccgtcgtcgattttgtcgttccacattccctgaattcactcttgaacaatgtgtcgcctctgcccttactacaagtagtagattcatatcccaaatagttctctttggtcaacagatactcgcggtaaaagtcccaatactccggattattaaacacgttgtaggcgtccaccagatgcgagttatcaagactttcgagacattcctgcttctcctcctccgtcatctgatccaattcgtcaaaaatatcctgcatgtggaactttcgcatcttgtccagggacaccattttgttgatctcagcctgtatctgcagacacttggtcaacagctgcttgacgcgattggggctgcctccatcaggcggagcaatgtacatcttggcctcggcatactggctaaacttgatgcggtcacgctctcgcttataggcctgaagctgctcgtcggctagccgtttctgtcgtatcatttctttgtcagtctctgtaggatcctgctttagttgttcaaagtattccttcttggacattcccagaaacttgcaagcctgcttgtcggtagaaaaagaagcgtacacagctccagagtatccgataacctggtcagcagcctcctcccagttgctgtacacacctggttgcctgcccttcttcacagcaaaccaacgcttcttttcaggctccagtttcgcctcatcagatagcaagtgctcaaggaatgagatccgagatgcaaacggatcgtagcacacatcctcgggagacacgtggtacatgcccatccactcctgggcctcttgcaccgtctccagcttcttccattcactttggctcatcttgccagtctctctgaccaccttatcccaatgcaaataaattccaggaaccagcccctttcgcacagcaaaaacgccgccggcgcgcgcaatctgggtctccatctcagccttgagttctctctgttcctgactcaaactggcaagccgcttctcgatagtctgtctcaacactgccgagggagccagctcaaactccaaggcatccttctgcgacacaaacgtgtacatttcggttgtctgcttgcgtccagccttgttgcgtccctgccgcttcactgaaaacgtctctgggggagtctgtggcactgcccgcacctcgggaggcgggtctctcaaaagagttggagctttcgggtaatctagacgtttgtacttctgatggcgaaagccggacgagagtgacacattgcgaataaatatgcgtattgggatcgtcagcggtcgcaacctgatcatggcgtgaaaagttgtaaaaccactcatgcaatattggaactttgatctgctgcatgctgatcagctacagagcaggatgcgggggtgacaaaggcgaagggagtaggagatagtaaaagatgaacactttgataggatgtagaagtctctgtggttcaggaattctatttttgcctgtttactggtcatattccacacattacttcacagtataccgtctcgttgtatggagagtgactcaggaagagtctcggtaacgtcataaggcgggaaatatcctgaggatcattctgataccatgatacatagggtagggtatatttcattgtactcgtgttcaataactccaacagatcacccaatacgtacgcttgtatttttttttattttttttctcacactcaattttccattccgaaaatgaactgaagtttgacacctacttgtagatgcagaaacaaaaaccagacaccaaccaacttgtaggctgtcattctcgtagttgcaataatgctgctgatgctgatatgacaggtgacagaatccagtcttttttatgcattctacaagtactgtaggtgctgtaaccattattgtagtccaatatctccgctcgacaactagtctaatttcaccaaaaaatttagttggggatttactcattaacaagtattaactgttcgtttagtaagtatgtgcatctctctacttggtttattttggcctttgttagttaggaatgtcaagtacaagtagcttcggtacgagtatcaactacaatgctgtatcgagccgtacacactgtatggcggcaaaatcaccctctccaccttaccagtacattctgacccaccccttttgccccctccatgttctacctcccccttcacgacaacaatacgtcaagtgtttcaaatgcggttgaatttcgcctgattttggaatttcagcagcccaccaccccaacctcggccaaacgaaagcggttaatatgcggtcgaataatatctggaatatctggaatattacgtcagattttacgtcaaatgttatctacaagtagcagccatttccttttctgtgtcaaaggcttccgtttctagcgtgacagctgtcgcccactctacagggccatgcagggagacacgcgaattaatactgcgacagtgcagagcgaaacttctggaatcaagctgaaacataaaaatgtacgactcaaagtcctgcctgcagcacattacagtagtacagtatgtacaagtgggaggaccggtggttgtatgtaccgcatttttatgagtaaaatattgtacatacaaacaagtacagtacagtatgcactttcacttgtacactggcagtgggtcccatgcgcgctagtgccttgtttgtacacgcaaaccactgtggcagacctacctcaactcgtacaagtgctcttgttctatacttgacatcgcaaagtatatacttgggtgtagcagttgagcacatacccgcaattgtattggttagaacgaactgtcaaatcggcttttactcggagaaaaacactcgttagagtccatcgtgtcacgtgcttcactcaactccagacgcccctcaacacccctgtagatgcatacaggacccacctcatgcgctgaaatgtacgatttcaagtggagtgcatggtggtggaatcctagcgtacgttattgggaatgtaaagcgggtgtctcagctccccctcgtctggttccgcgctctcttcgaccacagcaactggggaccgcaaccatggacacacacagcaaccagaaggcgcaaacaagtcgcaaacaagtcgcaaacaaggcacaaacaatggcttttttttttttttttttttctgcataaacattcatttaattataactttgctgtgaaagaataacctttgaaatgaatgtacgcttacacgaatattactaattaaacacgtttagtgtcatggtccaaaatggcttctctcactatggactctgtttcccccaaactccaacaaatgctaaacacacactgtttcacacgtgaaagaaaatacactcgggtccaactccacacacccctgtaactttagtcagacaaacgaacagatatacaagcatattccatgtggccatgtacaccttgcgtgcaaccgagagcctatctgcgtttgaaaaacagagtgtagcggagacgatttggatttttcacaaaaagcaccggtccatcttagtgtgtggtctggttgttcagagttgcacaggggtatcaggggtgtctatgcttgctttttaggctgctgaatcctgctaaatataacggcactgcacgataatagcttcagatccatatgataggaatatatcgtacgatactggatggcgctaccagttctatacgagcagtgagtgctacaagtggtattagtatcactgtggccattaattggtgtcggttctgtacatacaatgcctctattgttggttttgtcagcagaggtacttttttgcagcaaaacactctctgattgcactctgtctgcactctgtttgcactgggtaagtgcttttctcgtaaagctgataaggtgcttttgccacgctttttcagcacccccatattcttgtctatttcctttttgcaaacccagactcaatatctgccaatatggtgacaggcatggtgcatacgtacagtatgtaccagttttgcagttcagtacgatcgttagatagagcacaattgtatcacggtgtcttgccgtggaaaaggtacggaaacaaggtgaatctattatttatgattgaacggggctgccgaatcgatatctggactccacattgagaccccactagtttacgttccctgctacatactgtaagccagtcttcctgaaatcatcgttgccagcctttgccccaactatatgcactccctcagttcatcatattcaagaaaaatcactcacaaattccctctttgatggtatttcttttttcgggccgccataaggcgcaaacggccatcgacattacaagacacagggcttggtactcgatgataattctaacctaataagacgagatagacggcaaattgagtctttacggctgctgaagagtttgttacttgtgtgagtgggtagatgcttgcggcactgcagctacagagaagttatttgctgagtggtgcattccatcttgccatcttctggaaactacgatcttatctacaagtagtgatctctttgtattcaagttgatcttttttgcgggacctatcaaggtcaactctacctgaatcaactgttgacctccatcctacatcagtgcccatgtatgtaataattcatcaccagcttctccgatcagaatcatttgtatcgtcggtgttcaacagatgcgtctagctggttaaagctcgtattacagtattgatttacctggtgtgacttcttggcagggctctttgatctattttcaacttcaccacttattaatttatcgctatgtatttttttcaaatattttccaatttctcccgttaatttgagaaataaaaccccccgcttaatcatctctaaatcatggctcaagtttttatcaaggtgcattaagttcaacgggcaggcgctacttggaggcgaagaataattgaaaacaaatgtacttgctattctaataaaaatacagtaaaaataatattaaacatttcatatcaataattgcaaccagtaattcgttacatttcaaatgttttctcccttaagaatctcttaagaacaagaaccagttaatcctgtgccttctcagctccaaactctatctgaaaagtttctggttttccaaaaaaattcctcccgtgcatagtcttatttcccacccaccacacacacacacacgaacacacaatgggagcccccaagttgaaggattctctcaaggccgctaaggccaacgacaaggccgccaagctgactgccaaaaagggcgttcttcccaagcccaaggacctggcagtagttgccaagcagcagattgcgcacgaggacgatggagatgatgaggaggacgaagatgatgaagaggaagacgaggaggacgaggaggacgaggaggacgaggacaagactcctgttctgtctcgaaaggaggctcgaaagatgaagaagcttgctgctgctgctgctgctgccgaggaggacgatgatgaggaagacgatgatgaggttccccagctttacgacaccacccgtctcgatctgtccgagtccgaatccgagattgagaatgtcgagaacgaggtggaggacattcccctgtctgatgtggagctcgattccgacaacgacgccatcccctaccagaaggtgaccaagaacaacaagcctgccctgatgcaggccaaggctcgaatctcgttgccctacgccaaaatgacctttgtcgacacccttgtgcatacgtctggagccatcgagctcaaggacatctacgacgacatggagaaggagctggcgttctacaagcagggtctggatgctgccaaggtggctcgaaaggagctgctcaaggccaaggttccgtttacccgacctctggactactttgccgagatggtcaagtccgacgaacacatggagaagctcaagcagaagctgatcgaggaagccacctccaagaaggcttccgaggaggcacgacgacagcgagacctcaagaagtttggtaagaaggtgcagcacaacaagctgcaggagcgagccaaggacaagaaggagactctggaaaagatcaagtccttgaagcgaaaacgagctggccaggagatgacctccgaggagtttgacattgccgtcgaggaggcggctgccgacaaccataatattgagggcaagaaccacaagagacaggccaaggatgccaaatttggattcggtggcaagaagcgattccgaaaggccaacacctccgagagctcgggcgacctgtcgggcttcaaccagaagagaaataacgctcctgttaagaagcgtcagcagtcgagacccggcaagagtcgacgaaaccggggttagaacaggaaggtaaaaggaactgattattcagaggtaatagattgaatgttgaacttattacacgtgtacgagtagcatacccactgtagatctgcaaagctagatgaggttgaaaacgtaaatactgtagcgacgagatagcgaagatgatttgatagggtacaatagcgagtacgagcacaagtacccagtgtgtgatctacattgaaggggtataacttaagctacaagtacaagtacaagtaccggtataatgaggtggggtccatttgtgtatgtgtacgtattactaagtcaacatgtcaacatacaagtacatcttgtactagaacatactgcaatgtttcacagtgtaatctgactccaatgtgatacagtgatggagatgtgactcagctgtggctcaagccctgacaccgacaatagacatagagtcatgcttttgactgacactttgcaccatgaccaaccttttgcccacctaacgacttgtgctggataacacaggccacgcaccagagcaccaggtagactcggaccaattcaaacgggtaacggcattgttctctttgcaggcctgaactcaacacagcaacccttcggaccgttgttctcaaggtcaatgtcatccagcagagccgttcatacccaaattcaattgatctagtgaaccctggtcactatggtgatgtgtcacgaaaggctgtcccgattgagagctttcgcccaccaaatcgagttgtatcgtctcacaccttacaacaccgatctcacacttacctcattggtcttacttatctcacacccatctcatttatctcacacttgaataagaacttgagaccgacgaaacgatccaggtctctccctttatctcttttttttttttttccttttattactagcttttacactttttcatgggttattgcggggagcctattaaaatggtctataacttcaggaggggaaatagtgcacaaaggtacagttgttaccatatcagggtgggttagagtctcattaaggtaaaacactcgtggagttctatgtgcggatttgttgctgtagctgttcgagatgaaagtagaatgaggttccagtcggatcttccggaaggtatttttcgccgatctcttctgatctcgcgtggcgtgtacttaaagccgagtgatgttacttcggttagagttgacacccttgcagtcctgcagacacgacaaaggtgtcagttcgattcttggttgcgcagacagaaaattatcaccctcattagtcgaaatggcctgacagaagctgcagagaagagcagccaggtctaaaaatttacccgaatttttagtatgccggaatttcggcccttttctggttcagatccatcccagcatcatctcgttatatttatacttgtaccttttatacaaccgtacctacgtatatgtcagtcacttagctcccgcaactcatttttcataggcgcagggtgtggcgttcaaaagtgtccagtgagtgaaccccaagtttgacaagtaacatactgaccataagcgctcattgaacaaccaacagtgtgtcactcccctgtgcagcaagccagttcgtaaaggtcaaccattgtatacgatgctgcatccaaacgatggttggtatgcaatattggcaaaaagcagaccacctgtcaagttggttgctcttctcagcggtctcttttgttgaactggaacatgtgagatagccaagagaatgtgtcacatctctggagcagcgaatacaactcacaagggtcgactatgaggttgcgcgggtaaagtgtgcgctacaggatacgtacaatagacaggccccggttccttcaaacactcgagaagctaactccgattgttgaattgaatcgtttttttctgcgaaaagctgaatactgtaaagtcgtttgctctccaccgatcctcttgctcacagactgaaccctggaccttcaacaagagaaaaagaaacgaaagagacattgaatgattggatttgagcataggcaagtttagtgcactcaagagtagatggagttgttcaacttgttttccccaactcagccgccttagcgggttgacagtcgtataaccaaagcgtaaaggtcaggtacaaacgtaggtcatgttctattattggacgcaattgctgctgccaggggcgaaagaacaggtttagaagacgggaaggcagcggagaaggcactctgcagaagtcgcttgtttattctccttggggattgatggctgctttggcggggatgtatcgtcaacagatcgtaatagctgggaacaaaccaccggccccgatgaatagcagagctgccatagctcacaagttgtatgattgtttatgaaaggcacacaatgaaactgacttctcacaacctccgaggtcttacaaactactcaaatttaacgtcccaaacacatttttatgtgttggagtcgcatggaagttggccaacttccaaggcacttcgaatggaccctgtaacctcaattcagctgcttagcgagactcggagacacccgaacaaggactagaacgccgggaagcccatgagctgtttcgcttattccttctttgcttcagatatggaagtttgaggtggtgtgatgattctctaaaggatgacccttgactagacttaggtggtggctgcttgaaaaagcaacagcacttgcaagtatccacgaaacaaagaccgcttgagttttcctcccttgtaaccaagacctatagctggacgacaaggagagagtctatatgtcgataatgaatagaagactttgagtgtcccgttgcctgggcatcaaattgcttgactacttgtattctccaggttctatagactctagactctatagtcgttgctttttgtttctattcaggcccacgatttcggcccatgactttggtttcgacaagaactccacggttggtcatcttcaacccgcggatttagcagagcttcccgtcatcagacatttggtaagactctagtttcaccagatggcctggaatgtgcccaaaccgtcagatgcagaagtatacgattcatgtaacaaggaactctatccttttcttcaaccatggtcacgttctcatagctacaggggtggtcgtttacttgactttttgttttccaaccaggtcgcttgtctgcggggtcgatgcagggtgctgctttgacatatacggccctcatgctgggtgctctggcaggcagcgagggtgcgggatggatggagagtgagacaggagcattctcaacagcattcccaaacgggcaaaagagcagcttaaagaaaaaagaatatctttcgtctcagaagtccccagaaagaaaaaataaattagattccagctagatgtgcttttttaacgttggcccaaacagagcccactgccagggggccttcaagttggcggtgttcattagtccagcagcctactgtttaccagccagctgtgcttcgttgggtcccggatatggtacagacgcagcaagacaggacaaggagttactccgctgcacattgcattcgaccggaaacacggagagcatggcgtacatacggatcgtccaacagcagctcaatacgagagcaaacatttagtgccagtcaggttttctcctgagacactcggggttgtcgcggccaccgcagcaccagtattcaccgtcccagttggggtttggtgtcttacagacgtgtcagaagccaagcggctttatgccacctcccacccccttgtctttctccgatccccagcacgatgaaaaccttagccgagatgtcccttctatttcaagcatcatacgcgataccttgaaaattgtaaaaggtattgagtttccaaggttttgtgtttttgtatgccgggcagtaagcttttgcgatttcctccactttgtgttttcaacctcttcacacacataactccaaaccacaaaaccacaaaaccacaaaaccacaaaaccacaaaaccacaaaatgacatgtgcaggatgcgatcttgatgttgagacaaggtcaacaagagccaagacgtgaatgatgcccactggctgccagcttttgtgtttttcaccccgactttctttgtcttagggggttgtaaacagccagattactggttttggctcgtttcatccaaaaatggagctcacagcaattcttgagacctagagtggccgtggactcggacgggacgtcgacaagggtcttaatatcttctcaggtccttccctggcgctcaaagggactcaatagtgccctacaagcccaaagatacaggagttatagacaatccaccctagttataccaacccgataggcaatcgatctaccgatcatccagcgggcgaaccatagctccagacgtttaaacacaagctcagcagtgccgctgtgcaggttggcagccctctgcgagcaaaaccgtacagggacctaacctgactttgcaaacaaagaagacaaatcagtcagttcctggtgaatgcacaatcaaaccacccatgccaataggaaactgtcaattcgccaaagatataaagtctggacggaatcctccacttggttctccagcttcttcacgacactcgctcaatcacctaataccccctttctgttcgacctttcttttcgacgaacgacttaacaaccgtcaatgtgagtatctacccctccacacaacgtctctgactgatcgctgctcatcatcgccaatctcccgagtgcaaatccgactatcacgctgatcagtgctaacatagtacaagtgtctggtgcataagattcaaacttacccagtacttggctctgtgagtacgaggatcccctgcaactgtggggaccccctgttgggagagcacctgtcactgatacgcgactggcactgaacgggaatatccagggttaatcagtggcggccattccctctcattcggggtggtgtgttggatacttttcgctgtaaggtgcaggcccaccacaggcagggtcttagcgtggcactaaaatgctgctttactgggcagacagcaggctgccacgctaccaattgcaagccaatgtcaatgcccacaaaattttctgcaacaatgtactaacaacagataatgaagttctcaattgtgttgccccttgcgggtgcactcctggctgctgctggtcctattcagcagcaccccatggagggctgtgtcccccgaagtgtcttcgaccttgatggttgtctcgacacttgcaacgatttcctcgtcagcgactctgaccccgagcaggtgagtatccaccccccgttttgaaaaactgtctcactatgatgtttcacgagggcagccatatggtgatctttctactcgtttaggcggggtgtcaaaagcttaaaggcttagacgtgaacgcaccagaagtgcttttgtgcacccctcccaactctattttgacaccaccgtgttgttgtgatgcttgagcggtaaactcaacctcacaacctcacaaacaccacacaatcacagaaactaacaatagtgcctgcagtgcctgactgtctatgagctcgacaacaaaaacaccgtgctcagcaccctggaggagcagggcctccccatgcagcctgaggtgcccgtttgtggtgtctccgcccccatgattacccccggccccgctattcccgttctcgctaaacgagctcccatctccaccgtcacatcttgctctgctcctcccagtgatcagcagacctgtttcaaccagtgtgccgctgtcattcgagacattgctctttgtctgggcatccagtcctgcatttgtgaccgaatctctaagaccctggacaatatcaacaactgtctggattgtgtgacccatttcactgccctgaacaacatcctggatatccccaaccagattgtcaagttcctggccggctgcagccagcccactactgctgagcccgtttgtgtcaccagtgtcattgatcctgatgtgacttgtgaacctcctcaggtgtccaccacctgtactgctcctcccaagcctaacctgtctttcttgcagtgtacccagacttgtaccagcatcatcaccaacgtcggtctatgtctgggtgttaaggattgcgtgtgttcgcggctgattggtctcacctcttccatcgctacctgcctgtcctgtatcaccatcttcgacctgtcggccatccctaacctggctactggtctgctcaactggcttggaaactgtggactggacgctggtcagactctgcagtgtgataccagcaccactcccggtgcttgtcaaaccatcgctcctccttcgtcgtcgaccgtcgaggccaccacaacttcggctgagtcttcttcgtctgaggctccttcttcgtctgctgctccttccagctctgcatcttccgagggaccttcctccaccgaagcttcttcgtctactgaggctccctcttcttcttccgaggctccctcttcttcttccgaggttccctcttcttctgaggcccctagctcttccgctgccgagtcctcgaccgaggctgcctcttccactgatgctgcttcatcgactgaggctcccgcttcttcttccgaggcccccagctcctctgctgccgagtcttccactgaggcttcctccgctcccagctcttctgatgctgtctccagcactgaggctcccagctcctctgacaactcggctgcttcttctaccacagatggatctggcgcttcttccactgatactggtgcttcttcaactgatactggtgcgtcttctactgatgctggtgcttcttccactgatgctggtgcttcttccactgatgctggtgcttcttctactgatgctggtgcttcttccactgatgctggtgcttcttccactgatgctggtgcttcttccactgatgctggtgcttcgtccactgatgctggtgcttcgtccactgagactggtgcttccactaccgacaactcaggtgcttcttccactaccgacaactccggtgcttcttccactaccgacaactccggtgcttcttccaccgcctctaacactgacggctctggatcttccactgatggttctggatcttccaccactgacaactctggccagtcttctgtccccagctctgtcactgctcctccttcttctgcaacaggccctgttgctactacgatcacttcttgcagctccatcacctaccccaaggagacctgtattcagaagtgcagtgatgtcatcagccaaatcgctctctgtgttggcgtgaagcagtgcatctgtgaccgactccttactctcaacgacaacgtcaacgcctgtctatcttgtgtcacctacattgacttcactggtatctttgatattcccggtcagcttctccagttccttggccagtgtgatgttgctactacccctactgaggtttgcaccactcagactattgaccccaacgtgtcgtgtgagcccgatgtcacttcatccacttgctctgtcgttaacccctttgatctcactctgtcccagtgcatgaccacttgtactggtgttatctcctccgtcggtctgtgtgtcggtctccagtcttgtatctgtgatcgacttgcaaactctgccaaggatgttggtgactgtatccagtgcctctctctcttcgatcttggcaacatcccctacctcgctgccaacttcctcaactggcttggaaagtgtaacgttcagtctactgcctcttccaactgtgtctaccagaccatcaccggcgagtgtgtcaccaagaccccagccacttctgaggccattacgacatctgctgagccttcttcctctgcaggaccatctccttcaagctctgtgactgataccactccttcttccactggctctggatctggcgagtcctcctccgctccttcctctactggcggtgctggcgagtcctcaactacaggtggtgctggcgagtcctctactactggcggtgctggcgagtcctctactactggcggtgctggtgagtcctctactactggtggtgctggcgattcctctactactttcttttctgtttagtctggcggtgctggtgagtcctctactactggcggtgctggcgagtcctctactactggcggtgctggtgagtcctctactactggcggtgctggcgagtcctctactactggcggtgctggtgagtcctctactactggcggtgctggcgagtcctctactactggcggtgctggtgagtcctctactactggcggtgctggcgagtcctctactactgggggtgctggtgagtcctctactactggtggtgctggcgagtcatcttctgctccttccactactggtggtgctggcgagtcctccactactggcggtgctggtgaatcctccactactggtggtgctggcgagtcctctactactggcggtgctggtgagtcctctactactggcggtgctggtgagtcgtcttctgctccttccactactggtggtgctggtgagtcgtcttctgctccttccactactggtggtgctggtgagtcctctactactggtggtgctggcgagtcctctactactggcggtgctggcgagtcctctgctaccggacagtctactgatggcaacaactccaacaccaacacaggcgcttcggagactggttctaacactgcctctactactagcggtgacggtaacaactctggttccaacactgctactcagaccggttctaacactgctacccagactggcggcaacggcaacaactctggttccaacactgctactcagaccggttctaacactgctacccagactggcggcaacggcaacaactctggttccaacactgctactcagactggcggcaacggtaacaactctggttccaacactgctactcagactggcggcaacggtaacaactctggctccaacactgctactcagactggcggcaacggcaacaactctggttccaacactgctactcagactggtggcaacggcaacaactctggttccaacactgctactcagactggcggcaacggcaacaactctggttccaacactgctactcagactggtggcaacggcaacagctctggttccaacactgctactcagactggtggcaacggcaacaactctggttccaacactgctactcagactggcggcaacggcaacaactccggttctaacactgctaccaactccgacgataacactgcttctcctacatcttccgctgctaccacctctaccactggtggaaacggtggaaacggaggcgacaacggcggaaacaacggcggaaacggaggcgacaacggcggaaacaacggtggaaacaacggtggaaacggcggctctgatggtggcaacaacggaggtaacaatggcggttccaacggtggaaacaacggtggaaacggcggctctgatggtggcaacaacggaggtaacaacggcggttccaacggcggaaacggcggctctgacggtggcaacaacggaggtaacaacggcggttccaacggcggaaacggcggctctgctggcgacaacggctctggctctggttctggctccggctccggctctggctctggctccggctccggctctggttccggctccggctctggttcaggctctgagggctctggctctggctctggctctggctccggctctggctctgaaggctccggatctggttctggctctggctctggctctggctccggctctggctctggctctgagggctccggatctggttctggctctggctctgagggctccggttctggctctggttccggctctgagggctccggctctggctctggttccggctctgagggctccggctctggctctggttccggctctgagggctctggctctggctctggttccggctctgagggctctggctccggctctggttccggctctggctctggctctggctccggctctggctctggctctggctctggctctggttccggctctggctctggttccggctctggctctggctctggctctggatccgagggctccggctctggctctggttccggctctggctctggctctggctctggatccgagggctccggctccggctctggctcggaaggaccttctcaggccaactctgcctccacttttggcgtttctgctgccatgatgactattatggtcatggcagtcctcttctaaggactccccagttaattatggacttatttaatgaaaaacacatgattttgtgactcgctgaaagtttggatttgtcttctcctgttcttcctcgtactgaattaaatagtgcttttgttttgtaaatatattgtccgttgagaaatggttataggctgtgtacagtgaaatactctacccttaagcgtaaagtgcttgtacaatagctactgttcgtactcctatcgagaagttaacatatccccattccctgcctcggggctcctctatgaatgtctgtccgattgaatttctctaagcaacactgagtacaattacaagtatagtatgtaagagcaataatatccaaagtgctggtatgttcacttattcatccctgtccaaatgaaacaaaccatgaaagaggtgttaaattatcggtctgctacagtaggtgcaaccgccaagtgtgtaccgtatattacaagtagcaaggaatttcattaggggcaatttggttacctgatactgtatgtactgtagatattgagaagggaaaaatggtttatttggcgttgcgatctggacatccggctgtttagcctgtgatggaactagagacgagaatacggggacacgggttgagagcaaaaataggacagtgaacaatacaagacttgtaaatggtatcggtatgtacaccgctacttgtagctaccttctttaattggaatgtagttgatataactcagtgggctaagagaattctctctttgagtggtctctgatagggctctgagaacggtcgtgcggttgcgcaacgaaggagcagtgcacacttttgatataagcctctggtagtctgtactaactatggggaatcttctatacgacttacttatacagtagctacagtacatacatgtattattttaataacacctacagtatgtacattgttttctgggtactctacgagagtatactgtaggtacagtagagtggacttgtagcaggatgaatggaaattggtggtcatacttcctgtgttgcgcttctatttcacgacatctgcttatggtaagggtgattctactagtcgtagaagtactgtagctactgtatgtcttgttttccaagattgctgctgaccctctccgcatctctcttatcagaacagactctacggcagttttctcttgctcttcagtcaaacaaagctcgtatcaactgtcgcgcccctcgatagtgcatctttctcccttcagcctgtctataactcgactatagaataatcccgttatggcggtgcactaaatgttttgtttaagccccgccagtttcagcgaccgtcaaactcaagcaagcattggctactaagagcgggctaacgtagcgtagcaactcaaacgatgttgcattgtgggggaggtctggaggcgatctagagacaacagggtcttgcaatttgcttaattgatgcctcgcatcgaaactagttgtctttctgccctggattttcgacccaagccgtatacaacgtcccgttggaatgcccctctttaaccacatgactgttttctcccggcagtcatgtgccacgccaaaaatggcatgtgtgggcacagtaagattgggttaagtttgcttatcgttacttgataatgcagatagctgtgggaggggtgtgggtgtgtggggcacgtggacacgcgtgtagctcgattgtttgagtacaaaaccggtccgaaaaggcggcatttgcttactcagcacacctgactcgctcctagcgtccaattccgacgctcctcaacctgaagggccgcgtgggaacccaaatcaacctaaaggtcacttgcacaccaactgcagacgaagaagccaaaaaccaaaatgcgcatgcgcatgcaaatgcaacctgacctctttctccatagtcgacatcaccaggcatactaaagtcattacatcctctcaaacgccgctttttcttgtctgctagccagcgccacccgacctcgaagccacgtgactctattcaacgttgctccaaccctacaacctcacaaactcagtggcaaattgcacacgacttgtggttttttctctcacaccacaaacagtccacgtaaccaaacacaaacatgttccacgcattggggtgagtatagaaaggaaacgctgcagaaagataccgacacgttgactcgctatcgggacaactaacatagctccatcgcctcggtggtattccccatctttgcctcttatcgagccattaaatctcacgacatgacctacgcaaccccctggctcaaatactgggtggtcatgggcatcgaacaggcgctcgaaaacacatttggagttgtcctgtcagttctgcccctctactcgctagccagactcgtttttttcgcctggctggtgctgccccagtcccagggcgctgtgcgactctacgacgagaaagtcgagcccttcctcgaccgttacaatacacagattgaggacttctttgccaacggccacacatatgtgcgagactacggcctgcagtacctctctgtgctagttaaatggctcaccggaaaaggtttcgacacagaagcagccaagagcaccagcgccaaccccgctcctgccactcccgtggtcccacagtcctacatggactctgtgatgggctacatcaagtccaacagccctgccacaggtggcaaaatcacgcggctgttcgacatgtaccgagcggccggagcggttggcggtgcagtaggctctcgagaggtaacagagaccgtggagatcccctcgtctctgccgcactccgagcagctgggtctcatagacaaggagcgctctagactactggctgctctgtcgtctcttgatgctcgtggatctttgctcaagagcgacacaaagtcgaaatcgaatgcctcgctggcttcgggtgtcaacatcaccgcctcagactactctcccttgttggcctcttcttctgacactgaatttgacgttgtcaagtcggaagatgtgcttggacttgatgggaacgtgaaggacgaacgtcccaactcaaggggctggttctggcagcgtcactactccaaggttggcgaggccaacaaggctggctacgagaaactcgtagatcccccatctgagcctcctgtatctggggcgagtatggctcgagaatcagaggaggaggagcctctcattccctccaacctgtaagggcatggtacctgcagctccttcctagctgactacctttggtacaagtagctctcttcccaactatcccaactccggctagttccagctatagttatatttatcacggacattgttgtagttattgtcgctgtcgtatcatttgtattcacctcgttctagtatccgtctatgtacatacactactcctggtaagggtaggctagggtctctcccttgagcttccacagcttcttctttcgcttgttgacaacatgtgttccccacacctcctcgcaatgctgggccttgaactttcggatgaacttgggctcccacagctcagaagccacgcccaggtccttgcagcatcgcatcatggcgttggatttgcatccttcagaggcagtaggaacgccgtcttcgttaaagtaggtctgttctcctcgagccacagacacaagtctcccctcgcagatgagaccgtattcacgcgtcacaatcttgtcagtgacaacggtgtcacttcggggggccagaccccatcctccaggtccgaacgccgcattcaaaacacgtcggtatttgatttccggcaggtacagcagtccgtcaggggtgatttcgatgtcttcgactgtgagaggagcctggagaacctgggcggcctccttagagaaggcttgggagcccagaccctggaaagactgttcccagtcgatttctcgctggttcatatgctggaagacgtttgattgggctccctcaggatactggaaggtgggtgcttggtcaactgtagacgtgtcgacctggggcatatcgtcggcttcgataggctcagcggcaggagatgaagcagcaacaggagtcttcttggtggcgttgctcacagaggcggtggaagcagcagaggcagcttttcgccagtacgaggaggcagcaggctttttagcaggagtagcaggagccgaagtggcggaagccgcagcgggtttggtagcagccgcagcagttcggtaacccatggctcgaacgccgcgcgcaaccactagcgctactgtaggtctcattgtatcgtgatgttggtgtcagtatggagcaggtccagtttacatttcatttttcatgtctgatacgggttagggtttgtgtgtgtgaaacgtatgactcagataacgtctattgggcgctaacgatgtgggaacaggtgcgaatatttggttgcgtttaggatctcagagtggttcttccttattcagttgtcgtcaccaagctctggtacagtatctattacgatgattgagtctatggttgcatactacgcgcaaccaagcagcggttggcaggtaatatgagtctgaagtaagcaatgaagatctgaaatgatccaaataagtaagaatttatttcatgaatatctcagatagaccttatcaaagaataatgagatccttggggttatcaccacacatgcctcattttggtccatgcgtttgtcatgcacagcccattctggaagaagaaattgaggtgcttctttgggtggcaaaaaactttgtcctcggacggtgatgctgaggagatgattgaaagcagaagtgatcgaagtcggagatcgaaaccggagaagaagatatacgaatcaaaatggatggcgcgtataactggtaatttcaatttgccctgatataaaagcagtccgtgcagacgactcatatcagctattccaatagctgaattgaatatcaggggggtcttcgatggcttctctcaggaaggctacatatgtttccaagcagccattagtcgggattttgctgcaggcgaagcagatccggactccttccaatctaccaatgcctccagagcagatttggacaaggtgagcaagaagagcaagaagaccagaactgaaggtatgaccgcgagcgcactatgcactatgtatgtacagtatgggatgacataaaccacgagtaaagtatgtacaatagggaatgaaatgcgagaatgttccattattcgctcaaaggtccacaactattagttgcacatgatttactgtgaatcatgtttctactgttgaatttttttttccatacagcctcatatgtcttttcgtctcatctcatatttggggctgattttaattcttaccttagccgtagctatcgtcctgaatagtacatcgccgttcacgacagtgcttcacaatgagaaaaaccaacaaagacaacccagccgccacacaaaaacaaatggcacaaaaacctgcaacgcaaaagtctcctctcaaacccacgcttgagcaaacagagctgtacaggttatgcgaagatctacagaaacagtcgccctcaatgctcctttcactaccctctctaccagcgttcatccgcactcttcacgcagaattggtagcaaagcgctctgagaagacttccagctcgtcaaagtcgtacacagattccccagttccattcacgccaccacccaagagacgtctcagtgagcacatggtgagccccaacatgaagctacaccgctcagacagcttcgattacgacaccacgccaaccaaaaagagaaaatccatgtgagacctacctcctaaaaagggctcttctggccaatcctcgaatcctagtcgcccgagccgttatttagtgtgatcaagcttatgatgatcttgcactcctgtagtggcccggcttcggctctgttaccggattcaaacgcaaacgatacgaaatcacggcaaacataccaacacagctatctgaaatcgcctaacttcttgcaatatgaacgccaggtccggcaaaaatgcccattgcgccctccgcagtatgtacagtaacatgcggttgtacacgccgcaggcattatttggaatggggaaaatatcatgaaaagtgttgtatctatctcttgtagcaaggccctctttcaaccacccagcaattctcgaattacgtgaacttgctacaagaacggaacaataaacgaagtccctctcaaatctaacaaataaggtttgatatggagatgtggtcatactgcaaccatgtatgtacaagtacaccttaaaccttgtgctagtatatgtttttaaattggtcccaaatgttggaagcaaggagttgtgataggggtgggagtgaaaggcataaacagacagtgataactaatttaaagtagctatccatgatacacagtttgcagaattatatcgcttttttagttaccccagcgagcgcctctctttcacaaactactctcggtaatctgctgtggagctacttctaagcgattactgtagttcggtgtaccagtcggtacactctatatctgtcgcaacatgaccatcacctcatttccatctttcaatctgtgttcattcggcactctcactacgagttcattcttcgtcggtttcaccagcatcaacaagtgtctgttgtgtctactggacttcttcggtactccttcaaaaaaaaaaaaaaacaaaaaaaaaaaaaacaaccaaactcaagaagaaagttgctacgaaaaacaccaaaaagacagttaaaactgctgtcgccatggtgtacacagctattagatccccaccctcggccgtcaagaaagtcggcgcaatggaaggtaacaccaagttcaagatccaagcagcagagaaaggagttgggctgaagttctttgtaaaccacaaagcggactttatagctcaagttttcccaacaccttccgttcatatgaaggagttggaattctgaaagagtcagagtaagtgtttcgtctacagcaaagaggagattgaaccacgtaacttgaagagtcgtctgtagctgcaactatcgaagatctccctcatctgtattgacgagggattaaattctccatgctcccttggaaccattctttaatcttcaaatcagctctctgtctgtgggtgagtctcccacacagatgttattcgcgtccacttactgtaatctaagctcccctacgtcagaaccatttacggaagctcgcccaacttcaactgaaaaacatcatttcaatggggaggtatcctgaaccatcaaacgtcaattggaataactatgagtcttcaaacttatcgcatgcctctggtggtgtggaagcaatcccttcattctctttagaacggtacgataacgcttttgacgcttacgaattcgaagaggaatatctacagtcacatcgccgaacccatggtgaagtcgctcttctccaacacatgaccaccttcattcgtctccagcttcatctggtggctcgcccaggaaaaaccgaagaaagctcacacactcttcagaagacgagatgttgaaatgtgagcggcagtctgtgagacgcagcagcaacagaaatgagtctcttgaccgtaaagaagatattgacgtttctacaggtacactacgagtagttgcgttctgggtgtcgccgaggaatcgaactgagtagcgaaaggcaaccgcacagttctggtaacctatataacaagcaaaccttattcccagtcatattatgttaaggttatctgattatgcacgggtgcagactattgtaacaatgcccgattctggtggggttctagatctttgttagtttctgtgaaatgtttaaaaaaacaacaaatcgtttgttttatttgtctcgaagttggagtttatagaattttgggcgactggactaggtagtgtagacaataccacgaaaaatcgccggtgtttgtccgatgtgttgtgaagacacagaagagctcaatggatatcttaggcgggagaggtttgaaaagttggcagttatatacttgagttgcttgctgaatctgttagtgtaataataacgaccttgggtgggctgtgccttggaaagacatttagacaagcaaacattagttcagtgaaggcataaggtgagagtgggattgccagagtctcgcatagtgtccttaagtcaatttgagagtagtttcaatggacaaatggttttgttttcgaagtatcggatatgatccacagcccatcgtcgtttttatttgtaatcgagtgtcattctgttgtgaagagatgttgcaaaaccaagttgaacagcatgccatgtgtctgtgcctcggagtatgtcacatcatgtaacatcaacttctgttgtcccttataacggaaacaccatacctggaaagcacattcaccctcattcggttccgacagggaatggggattgatggtgtttcttgctgaaaattcacccacatctagaaacaccgcattcctttgttgtctttgtatacttttcctccagtgccgtctatcattgaaggctcaagattcacatgtgtatcctgggcatggttttagaagttgcacgctggttagccgaatttcagccgatcgatttgaagagcgatgctgattgaattgcgatataaacgcagttgatcatgtgtgaaaatcaaagccgaggttacagatcaatccttgactcgtcacctacgattctgtgttctccgtgcctgagctttgtgcgtactccggtttggtgtgtcccaggtacatacacgtatcttccacctcattgactacacgggattgtgtagttgatatctaagagtccattcgattgacttgtagaagtttgaaaggcacggcatactcaagaacatgtaaatacagctaccgtatggcaaaattgaagacattagttcgtgaagcaggcttattgacactgtaatgcctctaaatggcactgcgacccccacatcggcaagttaggtatgagaaaatgaactgcacagtatgcacaagtacctatttcgacttcacgttctcggcaacgggtcggtatcgtttctgtttgtctcatgagacttcttgcaacatgatcagccacaatgttgcgatatagcttacaagatcaattccctcggtccactcataccccacactttccatgtgaatcgagtcttatcacgttccctccgccaagtcgccccgtcgccgcaacaaccgaagacgatctctccaacggtgttagtggaaaagccttttttgacggaaaaatggacacgggctgctgtgccctatgcatgcttcttaatatgggtgagtgtaaacagtatgctaggaagatgaattggctgtatctgggacattgtaatactttcagacattgtcagatcacaaatggcgctactctcaatggcccttgcagtgactaagcactcttaacgagatggcctccatagtcgcttatctttgagcaaatttccttggatttttcccctttctccatgcggctacctcggtacgtgaggctaactgctgtttcagtcaatacccggactattttgccatgttccggctctgatggactcggatctttttcatgtgtgcttggattctgcaacagcgggtttaagagttttttgaagcggggaacattgtggtgtcaacgggcatacaaggagtatatggatgtttttctggggtcacgtgagtcgtttggagccactttcctacggtggatatttaattcgctatttatttcacccgcgccgctaatggtgtataccggttcacactcccctctccacgctttcagctgaacctcggctcccaaataagctttacgccgttttatgctcgagcagtcaagcggggtgcatcgcaacttttatccgagtctggggtagaccaagaaacgggctttataaatatcgctgccaggacaccagaaatatagtcggacagcacaactggttggatctcagaaacaacactagaaacaacacagagccgacacaaacgacgtttaacacaaaaagcttagctcacacgttaccgccttctgtattacacgaagtaccacaaaccctacacacatcgccactgacatacttctcatttgtcataaccaccaccacacacaccacacacaccatacacaccatggccgaagaagttattttcaagaagacctacgtcaattgtcccgcggcttacccccggaaccatcccacctccaccatgcaccctgacgaccgtctcatcgttcaggctgctatttacgagcccaaggagttgaccaaacccctcaagggctctcccaccctcattttccacgccgccaacggaatgccccgagaggccttgatccccttctttgaggatctgtacagcctgctcaaggacaacagcatccagctcaacggtatcattgccttcgaggccgtcaatcagtgcaactccaacattatcaacgaaaagtttctaggagacacgtacgagtggaacgatggtccccgagatctgctttcgggtctctcttatctccgattcggcaagcaccctcttatgatgagcggtcctcttatcggaatgggccactctgtgggaggcaacattgtgttctctctcgccgagcagaacccccactacttctgcatggtgctgggtctggaggctatgcttctgcccgatgaggctcgaatcgacatgcgagactcgtacgccgcccagtcctacaagcgacgagacatctggcccgatctggagacagtcaagaacaagttcgccaagaaccctgccttcaagaactgggaccctcgagcttttggtctgtacctcaagtacggtttccgagagctgcctacacacctctatcctaacgagcgaggagtcactctgtctaccgataagcatgccgagacccacctgtttgtgcagcgaagcaagaaccccaacgccgaggtgccttttgagcgagaagagccccacgaagtgttcaacgatcttctcaaaatcgccgtgcccaagatgttcctatgtgctcaagattccttcattggcatctttgaggagtattaccctcgaatcatgaagcccggagacgagttcctgatggtccccggcagccatctggtcccctatgagcagcccaaggctattgctgaggcctttgtccccttcatcaagaagaactacttccagtgggtcgaggatcgagagaagaacatcaagaccgttcgaaagcgaatgatcgaccaggagtttgcagatctcattaccaacagagactccaagttgtagatgaagtccagagcaaatacatttagataacagtgtgctagtgagtgtgtagttgctgtaggaacaagaatgttgttgcaggccccttgtagtgaatccccaacacgagtagtaataataatgtacagtaagtgccgtttaacaaggtcacgaattgcactatagttatcttaatcgttgtctcgttgtctgagctgcatacattaattgtattatcctatagattccacattgttgaagtgggtgaatggatttacagtagcttcattatagaattgttgaatggtacaagtactgtaatcgtattgttaacccatattcgttcattttgttggccatgtggacattcagttgttgcaattgcgcacccggtcaagcaagttagtacatactgcacaaacctatatgatccatttccggtcattaatctcctcgtaatttggaaatcctgggcaaactatattgattattccagctacctgtcaaaccgctgtaactgtcccgcacttcagcgttcaggacgttcagggaacctgctacagtatgtacagtagtagccgtgtgaggcgtttaatggcgagctcggacaggaaatgagaggtcaagcgaggcaaccatgtgacagcaacgaagtcaacaccaataatgtatgccaccaccttcacttacacaaccactccactgtacatacagtacagtaatgttagtcagagcttagtggctgggcaagtacaacaactggctttgaagagagctgaagctcctcaaggctctattgggcgctagcaagcaaatttttggcatttggaaagcctgataagacgccaattattcaataatacagctttttcacacccaccacctccccaccatgtagccatcctccctgcatcatccccttacgtgtcatattcttaaagtttggtacgcgtctcggttagacttctggccatctttcactttcacacgtatcgggattcgtttttttttccacacagctacacacaacaagatggcggaattgagaaatcgcaagggcggggtggctgccgagcctgcggcagccgactccacccccaaagtgatggtcaagcccaaaaagaagtccaatgccaagtacttccaggccaacctggtgctgactctgctggcgtttctgacccgattcatcatgctctcgcaccccgacgaagtggtgtttgacgaggtccactttggcaagtttgcctcctactacctccagcgaacctatttctttgatctccatcctcccttcgccaagctgcttattgctgctgttggctggctgatcggctacgacggatccttcaagtttgagaacattggcgagaactacatcaccaacaacgttccctatgtcgcctaccgagcgctttcggcctccctgggctccctgaccgtccccattatcttcaagaccctccagtactctggctactccgtggctgcttgcaccattggagccgccattgtgtgtctggataacgcccatatcaacgactcgcgactgattctgctagatgccaccctcaacatctccgtggccctgtcgctcttctgctacgtgcggttctccaaccagcgaaagtcccccttctctctagcctggtggacgtggctcttctccaccggtatcgccctctcctgcaccatctccaccaagtatgtcggagtctttaccttcatggccgttggcggcgccgtcgtttacgatctgtggctgctgctggattacgagaagtctggtctctcgatgaaggacttcctttggcactttggagctcgagcctacgctctcatccttgttccctttgttatctatctcgcctggttccaggtccactttgtggttctgaaccgatctggccccggagacgctttcatgtcccctgacttccaggagactctgggagataacttcctggcccagcaggcccgagacgtcgagttctacgacattgtgcggtttaaacacaagtcaaccggcgctctgctgcactcccacgatgcccgataccctctgcgatacgaggatggtcgaatttcgtcccagggccagcaggtgactggatactccactgctgatcctaacaatgcctggcagatcctccccgagaaagacttccccgaggaccagcgagttggccaccctgtctacggatcgaacaaggtccgattccgacaccttgccaccaacacctaccttctgacccacgacgtggcctctccttacttccccaccaaccaggagttcacgactgtgtctcccgaggttgctgccgagcgatacaacgagaccatcttcgaggtgcgactcaacactggcaagtccaacaacgtgcgaaccaaggccgccgagttcaagctgatccacgacaagaccaaggtcgccatgtggtctcacagtaaactgctccccgagtggggctttggccagtttgagatcaacggaaataagaatacccaggaccccactaacacctggaccttcgacgagattgtcggtctgtctcctgagcgagcggccttcacccccaagaagacccgtcagatccccttcctgcaaaagtaccttgagcttcagggaaccatgttccgagagaacaacgctctgaccgcctctcacccctacgcctccgagcccatcacttggcccttcctcattcgaggtgtgtctttctggactaacgctcccaaccgagcccagatctacttccacggtaactttgtcggctggtacattgaggacattgtcattgctctgtttgttggcgcgattgctgccgaccagtttatgcgaaaacgacagatcaccacctttggccgacgagcttcctcaaagctctaccactccatgggcttcttcttccttgcctggagcacacatttcttccccttcttcctcatgggtcgacagaagttcctgcatcattaccttcccgctcatctgtgcgctgctctgcttgccggtgccggcttcgatttcatctttggtgagttcgaccgactcgacgaggaggccaacgcttccaagaaggatctggagtacacccagcgaaagaacaagcctctccatttggccaccatcactgttctcattctgctgaccgcctgcttcctcttcttctgccctctgacctacggactggctaaccagagcgtccaggccattcaatggcgacagtggatgaagtttgagcttcatttcagcaagtagatgcgctgatgcgaagaattatataagatacgagctcattacgtgagagataataaaatactgattgattgagttgtgtgtgatagagtgtgcatggtgagtgattagggggggacaagcatttgaaatgaatttcacttcttattgtagctactgtagatacttcactccaaagaaaagtgtcaaataatgagatattacacgtaaaataagtagtggaatacttggtgtagatcacaccttgttgagatgggatctcaaacgttctggatctacaaatgtaaccctgtaaaccactactgaagatcatcttcggtaaacacctcaaagaacactccaagtatttccattgcctcggctctctcatccgcaccatgtacatactcactcaacaactgacctacaatacgttctgtgcagctcctctctcatacatcggctttaagataaagtttcggagaagctcgaaccagatgcttgtctgagtgcgtaaatctaccgttggggacacgataggcccagcgaaaacggcgttcacatgcgtgtcgcacaaaaaaggaacaagatttgctcaatggacacggtactgtcttctctggggtcacgtgacgtaaggtggagctctggaacacgcatatccgctgcatcaccggacgcagcttcgcaccttgatttataaccaaggttcgtcttccccgcaagtggggaaagacatttgggggatgctgtgggatgtcttggtgacgtttaggggtggcaaaacggagaattttgcacattaagggggctgtatctgcacagtgcatgcagatctatttacgtgactctacatgactcaataaatgcgtcggatgcacatgtaacatgtgtggtatccttccaaagagtcgtgtttgatagtcatttagactctctcgactccccccacagacgcagactctaaaaggttattccgcccaccttctgaagtggtacttaaaggcaacttattgactctctctctataactgcaagcacaccagcaacaatgtcagtcgcgccaagctccaaccccaatccgatccaccacctgtcgcgtgttgaagacgttcctctgtcacagacgtttcggggcaacatcaccgactttgtgcgatctggaggatttgctgacgacgactctaagccctgttgtatcgatgcgaaaactggccaacaactgacacagaaacaagtgtgggactacgccgacaagtttagagcactcctccaccatgacaacaatctgtgtcctttcaatgccaacaccaccgatccagctcttggagacgtcatgatcaccctcgtgcccaaccacctgtttattacgtctctgcattttgccgcacttgatctgggtgcgacagtgtcacctggctcggctggatacactgtggcggagctcgtcaaccagatcaatctcaccggagcttctctgatcgtgtacactcgacccgtcttcaaggttgtgcgagaggcgctagctcagattgtggtaccagtcaagattgtggagtttgagggtctgattgaacgggcagagtttgttcagagccacaaaatccagtccacaaagaaggtgacactttctcctgaggagtcttactcgagaatcgcatacctgggcatgtcttcaggcacctccggaggtcttcctaaggccgtccgattgtcgcatttcaacatggcgagttctgccgagctctccaagcgagctgcaccttcaattgcaggatctgagcagattgcaggagccattatccctgttaaccatgtctatggtctcgccaagttcctgattgccatgccaaaatcaggagccaccacagtcttccactccaaatttgacctcattgagatcctcgaggcccaacaaaagtacaaggttaacatgtacgcccttgttcctcccatcattgtcgttctggctaaacaccctgctgttgagaagtacattccttcgctgagggaacaccttcgatacgtgtcttctggagctgctcctctgggtgccaacgtcattgaggcttgcaacaagcgccttgcgggaactgcttctggagaaaacgagtttggaggtctcaaaattgttcagggctacggtctcactgaaacctcccctgtggtttctactttcgatcccaacgatcctgagcgacatgctcggtcatgtggaaagctggttcccaacacccaggcacgaatcgtgtcggaggacggagttgatcagcctgcatatgagcttaaggacctgtctcagttggaggccgagctaaagaaggggaaccttcccaccggtgagttgtggcttcgaggtccccagattatggatggttaccataagaacgacgaggccaacgctgagtcgtttgtcgacgccactgactacacttccaacatgcccttctacatgaagcggtggttccgaactggtgatgttgctctagttgatactctgggccggtacatgattgtagatcgaaccaaagagatgatcaagagcatgagtaagcaggttgctcctgctgagctggaggatattctgctgggccatccccaggtagcagatgctgctgtaattggtgttcagcaggtggagaagggcactgaggctccccgggcgttcgtggtgcttcgagatcccaagtttgatgcagtggagatcaaaaagtggatggacgcccaggtgcccaagtataaacaacttcatggaggtgtggttgttctggatgctgttcccaagaatgccagtggcaagattctcagacgactgctccgtcagcgagagaatgacgttgttcttggactcgacaaggccaagttgtagacagatgttagattgaatgagattttgaatgatgagcggtacttgtttaggtctcaattattacagatggtgatagtcctatacatactctttaaaccactatcgtacgaccgctcgctactacattagggacctttcaagtccaggagctactttatttactgtagcacctgccaccaaccttgggctggttatcataagcatgaccttcagggaaacttcgtaatactgcccagaagaaggtcattgctcattcgcacatacagcactcgtatatttgtcgtatatttgtgtatcatatctcgtctgtattcggatctgccgtgtctgtttcacgcaatacgatgcatcttgtctgttctgccacacggtgagatctattcattgacagaaacaggattcttgtatgtccaaaagcagtctaatgaacttttataattttggggggaggaaggtcatgtatcaagttgatggcacaccatcatcattttatttgtcacttttcgcgcattactgaattttgccctcttcatcacctcatgtcacacgcatgctctctgcaaaccacttttggacgagtcaatagaaactcaatcatctactctaaacaagccaatgagctcatatagaaaaatgcccggggatttgagagctcctccaaacacacacaaccatgaaaaacgactacaaaaactcgattgagatggagtccatcgcggggtccgtctcggaggagtctatacccgaatcttctctaccaccctacacagagttcgacaagccagctgagccatgttcagtcttcaagttcacaataaagagcgatcttccatacatctttgttggaattgtgtgctgtgcgctagaggctggtgtgggaccgctacagacagtgcttatgggcaagattttcgacaccttagctaagcatatgaagggaactctggagaacaagttcatggcagagattggaaaatactgtggcatgtcgttgggtctggtatttctgggtttttgcaccgacttcttttccaacattgccttcatatattacggagacaggcagctgctgcgactctcccgcaagatcaaagatacatttgtcaagtacaagtccatggcctggtacgaccacaaccagggagtacagggcagcctcaatgttgcctttcgaaatattgaagatattcagggggcctgttgctctgctatcgccttcgctatcaaggacgtactcactatcgccatctctatgggagttgctatgtaccattcgtggagtttgacattggtgatcatggcaggtttacctataattgttctggtagctatgggagtggcacctcgtcttcagagacacttcagagactacaagggggttatcactgacgcttccgtcatgattgactggtctatgtccggcctacaacatgtcaagctctccaacggcgagaagaaacaaatgtcgattcttcagtatcagatgcatcttgctaccatatgctacatgaagttcacaacatggtctgctgctcagcaggcgttcatgcaggtacttgcactgatcatgttcgtccagggtttctggtttggggccaagcaggttcaaatcggaaacttgactgctggagcggtcatgacctgtttcttttcggcaatggctgtcacgtcccatattgcttccatcaccggacagatgatgtcgatcatgaaagccatggtatctgcaggactcgtcaaccagctcatcaacagcgccaagcccagcaaggtagatgttagacaatatcctgagaagtgcgatggaaacatcattttcaacggtgtcacttttgcctaccctactcgtcctggtgttcctgttctcaaaaacgtcaagctggagttcaaacagggccagactacgtttgtggttggtcagagcggttccggcaaatcgactatctccaaccttctccttcaagtttatgacagctacgacggagagatacgagtggacggatttgaaactagaggtgtttctacccgttggctgtatgagagcatcaatgttgttagacaatccacagctctgtttgaaacttccatccgagaaaacatccagctgggaagaggcgcagaatggaagtctgctactgaacacgacatcgacaaggcttgtcagtttgctctattgtcatctacgatatgtgatctcccccttggactggacaccaaaaccactaatctgtccggaggtcaacgccagcgagttgctttggctcgtgcctacgtcagaaactcgcccgttctcatcatggacgagtctttgtctgctctcgatatcgtatttagagaactcatggttgaggctattcgcaaatggcgaaagaacaagaccaccattgttgtcacccacgagttgtctcagattcagtctggggactatgtctatcttatgagagacggtgaggttgttcaaagcggtctgcgaaaagatatcgagaatgtgggctatttcaaggagctcagagaacaaggacagaccaaggaggcagataaggaggctccaccagtcaacgagattggtgactttgaccaaaacatgatcagaaatacctacattcccatgaaaaccacaagaggagtgcggaagtgggttgatgtgaaacccccacctcagagagatgttctagatcggaaacgaaaacctgtgggctactttgagttctctaagctagtgctcaaaacaatccccaacaagcccttgttctactccggtctgcttctctcgtttcttctaggtgctgccaatcctgcgttcggatggaccatttcgcaggtgatttctcaaatcatgcccaacggagagagcgactcttctcttaacaaaacactggtaaaatggagtctgatagttattggtattgctttgttgcagggtgcgctggctttcttacacacgtatactctagaacgagctgccaatggatgggctgtgtttttgcgaaagtcgagtttcaagaccgttgtgactcgagaaatgagctggttctccagagctgtggactcagatcacgatacgcccgatatagggcccttccactttgacagaaactcctcaggtatcaccgagctgattatcaacgagaccgaagaattacggtcggctgtgaccaccttcttttcagcggtcattagtattttcaccatatgcgtcgttggtttcatctggtcgctggttcagggctggaaattgacgcttgtgtccttctccatcttcccaggcttccttcttacctctcagctctatgcctacgtttcctccgtctgggaaatgggtcttagagagcgtattgtgcgtgtccagagtctcatccatgagtgtgttactggagtgtctgaggtgagaatccttaacctggagaattatttcgagcacaaatacatcaagctggaagatgccgttttgaagtacgccaaaatgagagcgtttttggtgtctatcacctatgcatcccatcagatgttcactcctctgcttcaggttatcattctctgggttggtatgaagctgatcaacgacggagagtacaccatggagaagctaatgggagtgatggtgattctcattcaagccatgactaccgccgcgggtgctctagagaccattcctcaaatgtctaagggcatgaacgtcaccaagacactgtttgctctgatggacgagggtcgtgcagagacttctgaggatggaggaaccgaatgtcctgacctacatggagagatcgtcttcagaggcgtggacttttcctaccaatctcgaaaggaagctcctgttctcaacaacttctcaatgaaggtcgccagtcaagaggcagtcgttattgttggcccttcgggttctggaaagagtaccatcaccaatctgttgacgaaactgtacccttacagacgaggtattgtctcaattggaagacatgacattcgtgacattgacactgcttaccttcgacagcgattagctgttgtcacccagtctgctgcgttctataacggatccatcacctcaaacctgacatatggttgtgctgctgaccctgaggagatagagcgggtctgcaagcttgttggtatccacgactttatcatgtccttgtctgatggttacaacacagtcattggcaacgagactggttcgggaacagctcttctctctggaggtcagtctcagcgactgtctattgctagagctcttcttcgtaaacctcagattttaattctggacgagtgtacttctgccctggataatgcctcggctaaggtggttcatgagctcattctcaagctgaagaaaatgcgaaaggtgaccatgattgtcatcacacattctcatgagctcatgaagcttggagatcgtgtactggtgttgggagctcatggagagggggtggttgagcagggtccttacaaggaactgataagccataggggacccctttacactctggtgaatggtggtatttgtcattgatccattctctattttattatataattgtattatttatattaccttgactctgtagcaaacctcttcctagcaaacctctcttggtaccaaaacatatgtttgttgttgtttctctcttctgacatcattacattacaaatctcccatatgtataaacagtctcccccttccatcttcattgtctatcaagtgcttcactgatgttgaatgtcattctgaatgagtcattgtaacaaccatgatatggagaacaatgactgactcattcagagttcttcgggctgggtgatcctttttctttaatcgtcagtaatgtcttaattaaataataagtctacatagcccactctccagcaggagtgagattctctccaagctttcgaatctccttgaggtcgaggtcaagcagcttctctgccagctttcgagggttgtaatgaccgtacttgatggtcttgtttccaacaagggcaacctcatcggagggccagggagactcatcgtagacgaacttgatcaggttggtctggtacttgttggccagttcgatggcccactcagggaggttgggaagacatttccacatgaagacaagatcgacagcatgacgggccctaagagaagggtcaaagggatcaacctggtcgaagaactgtcggtagacgtcaacacctcccttttccagttggccgagtagctctgcgttagacacgacaaagaaactatctcctcggaacttgcacacctcggcaccggtcaagatgctgtagatatccttgaccttctttccggtctcggaggagttgagaagaggttcgatctcggcaggtggcaccactcgcttcacaaatagagaaccctcatagtcgttgtcggagacaagagcggttctgagcttgggaatggcttgcagcaggttgtcaggcaaaaagtcatcgtaagcatagaagccaaaggggtattcgatcttgaatccggccgtgacgagagcgtagggagggaccttggtagggtcatcgagatccgcctcttcaacaccaagctccttagcagccttggctcggtaagtatcaagataagcaaccggaagaggaaggaaacagcccagagatccggaagacatgaaggctcggctgataacgccatggtgctcgaggccgtccttcagaacaagagcgtggacaccaattgagccagaagactctcctccaacagtcactcgctgagagtctcctccaaattcaccaatgaacttgttaacccactgaactgaagtccactggtctcgcagaccccagttaccctttccatccttggaggtggagtaaccaagcataccgagtcgatactcaatgacaaccatgatgacaggcttgccgattgcagcagagtgctccacaaacggagtaggatcggttcgcttgctgtaaatgtttccaaccaagttggcacctccgtggatgtacaagtagacgggaagggggtgcttgaagtcgcccttgggcttcacgatccgcaggttggtgcacagaagctcgtcgctcttgtactcgccatcgtgcatatcgtgtttgttgggcagctggggacaatcgtatccgtcttcggtacagtcgatggtctttccctcaaagtcagtcttgagaataggaggagcaaaccggtgcttgacatcggcgtacagaacgttcttccactggatggtctccccaatggggactccctcaaaagagccattgagtgctttcgagttaattgtagtcatggtgtgtgtgtgattgtgtagttggagtttctgatgggttgacacttccaagtcactgggtgattatatatatccgtcatcagttgtagtttcccttggttcatgcagcccagatgcgctaataaatccaaacgaccttagcttcggcgttagtgagctagccgagagtttaacgtcggcacgttgacggatcaaagaagatatgtcgactttagggggaaatgagaccacgaatagttactcaattgcaactgcacagcctcattgtattatgtaatcatttcacaatgtcacgaatacttcgacgcccctgtaaaatcctgtctactaacgccacccgagcgtatgtactgtactacacttctcgcaccgataccttctgtactccgtgcagttcggacatggttaactacagtagttccgaatctccgaccaacggctgcctgcgcgagcggctaaccttcaatcacgaaagagacctttttgcagctcgtggaaccgccacaggtatttgttgtgtggcgaccttcttcgaaattagccggggtacagtacgatgatggtcccaaaatagtcccatatgcattgtttagccacctgtcaaagtggggtaagctggaagatggtctactgtgctacttgtagtctagaccgcccacacgatcgccagcgttagactggttttcgtcatgcactgagtttcggacgacagagtgggtctctgtagttgtcactgttgaatcaagatgcggggccgaggttcaagtcgtgcttgctttcaaatttctctatttttctagccggacgtcttttcgtgatagattcagcgtgaatgatgcattgctcgtggacatgccacaatggttcgatcttctgtctaagagacgcgcaagaacacaccacttatagtaaaactgagatggtatggttagttggttgagccggatgacagtacatacagcatgacagtacattcggatccataggttgatacgatggggtaactgggataacggggtattggcgaatcgaatggaaccatcagtatcttacaggtctcatcgcacttggtcaattatcgtgagcgaatatcagtacagcactcctacagcaaccaactgacacgcccaaaggcgatgctggagcatttgggatgacaacaccattaatcatatatatatatatatatatatatatatagagagagagagagagagcgcgcgtaaatacattcgctcttatcaggcgccacaccgagtcttattcactcctttatttcactctaccacttcttttatagtcgcccaacctccttaatagagcccaaactatagcatgtactgtactgtactgtagctggagtgaaagtgtgttggggtcatgtttttgggagcgtcacgagtggaaggggcagactacaaataccatgaccaaacaaaacatggggaaataaaatgtccacgctaacacatagacacgcctcgtggacggtgcaggtgtgtacgactgctcacatgacgctccattgatgcagcggttctgtcttgtaatctgtcttctgcctctggtctacttgtagcacatcaccagctccatcacgtcagacgacctcattagctaatcaaactccggatgcgtgattgggatggaaaaggagccaccatagcagacggatttgttgatttgtgttgaatcgagccgggaccgtcactccactcaccccacctggtgaacacctgtggagaacatggtccacacgacctgtctgatgtgtcgagacccgctgaggcggctgaatgccactcctccaccgggcgtgcggatgactggatcgcacacattgccacacctcagacgttacatctcctttccgacgggttccacgccttgttctggagctgattgtcacgctggctggaaggtgttattctctcgtcaggctaaaaagcccagggcgctaacgtataatattggccgatgcaacagttgacttggaggagcaagataaaggaaggaaacgaaaagtcagctacagcatagacgacacacacgcgctgcacacatcaccctacgtatagggtaaacccctcctataacccccctcattttttgagattgttatgagacaaatgacttggaagttacaattccaccacagccattggtggataattacaactgcaacagcatgaaccagtccccgccggtgtgttttctaaccctcattgcgcttgtctacctgtactggtttgccactaatctccacactactctgacaatgttaccacacgctagaccaggcgagtacgtaatccaagcacgtccccaaagcctaccacgtccctttcactcccccaagggttatatataaacacgaccggtaagatgcgcatcccacggcgaatgtatataacccatgtcttcagcttcggtcccagtatcaccatgaccaccgaatacgcatattactatcttgatccaagtgagtgtgagctgcctagcgcaagtagcggttggctacgttggaacgcgatcccagggtcttttgattccaaattcccatgttatcttgatccatttttctgatccattgcttcctgttgatccatggcttgtatccatgatgtgtttctcttgatttccactccatggtatcttcttacccaccttctactgaccagattggaacgcctacacggccaccacggaggagcttgtcatcatctgcggcaaccacgacctgacgtatagcctgccggtccgccgcttggagctcatctacgtggtgctcacggcaattccggaaatccgcgccgaaattgccgcctacagtgattgcggaaccccatgagactaccttttgtcttttctccatgcctttccttcgtgtcttgtcttcttgacccttctggcaccccgttgcaaccccaatcattgtattatcaaatgtagatatttatgtaacccaataatgtaatagagagctgagctgaagtgggtgggttagaagaatgtgaatagtgtggagtgagggttagctgtgccaacaaaccgttgtgtcagttgtctgtgtacgaatgcgataggaatactgtaccaatacatactgtaccggtacgagtagttgtatcgttttactgtgtctcaccaagaaataatccctacttatatacgatactccacagaaccactgcaaccccaaaaatcacacctcaactcatctcaaacagacgcattcggtgtcgtctcaggagtcgtctctatacccccttgtgtcattgtcatgctgtcgctaacatccagactaatgcattcgtagcactaaattacacgcactatacgctggtgaatacgtgcctatgtagagggagtagaacgtgtcgcacgtttatacaggcctccatcagaaggagtttcttctccattggtgcagcctgaaaacacgctctatctcatttttacttcatgctatagtaaacatttcatctattcacagtagaaacgaaactgcctttataatcagagacagtaacggcctgaccaactttcaattcaaacttggcattgtccttgtttgacctctctgtcacgttctacgaaagactacagtattgcaccgcttgtttttgcacaaccgtacttatcatactctgctgatccaccgagtcattggtagtactgcttccatacagctcatctactcattaattatatagtctaacacctctaacgatcgccaaagagctctctaaagatggagacaaacataggggatatcgtcgacatcctcaccgtcctggtcctcggcacaaacctcaaagatcagagtcttaacgtgaggctcgagcttcttcttagtgacggcctccaccagctcggtcagagtcaaatcgtacttctcgttgagcttggcaggagggaagaaggaggcgtacaggagagacacgttctgggacagcatggtcaccgtcaggttgtagttcttctcaaagaactccaaaaactgcttgagagtcaagttctcgtgaatgtcgtatcgaccccagatcttgtccagctcgacaccagcaatctccatcttctgcgaagcaatgggctcagagaagcccagaaaaggcagagcgagattgacaaagccgttcttgtagtcctcgatcacctctcgcttgtccaccaccttgtagagctccagacagacaagaccagtcaccagagcagtggtggtagcaatagcgggaatgattcgtccagcaatgaacttggtcttgtgtcgatcagcgccgtcaatagcgtagttctgagctcgacagttggaggcagccgtgatgaactggatgtggaagttggtgtcatcgtccttctcaaactcaacgggagtgagtcggaaaccagccagagaagaaggaggaggcagcgagttggccagctgggtcagctcctcggagtcggcatccacagggtcgacgctctcgttctcgttggcctggatcttaataccggacttgggttcaaacttgggcacagtcatgttgtccacaacttccttgtactcagaaacatcaaggtcatcacctcggataccgtagttgaaggctcgcagattagcgccagcaatgagaaaatccagatggtcctggttgttgaaatcaaattcgagagcgtcaggagctcgcttaggtccagaccagaaaggagcaccagtagaagtggtggcgtccttggggaagttgtacagaagctgactaatgtcgccgttgaacttcttctcaaactccagacgggcccactggacacactccttgaaagtcgtaggtcgttcgtccaccaggtacgacttgatgttctccagaatagacttctggtcaccagtctgcttgagggtggactccacaaaattgggctggctcagaaacagattcacagactcaacattgtcggtaaagtagccctggaagatggatttggcccaggcaatcgtgtggtcaaccttattagggaaagatcgcagagtacagaggggaatgcccttctcagggggatcctgggaggaagagtacgattcagtcaggttggggtagacaacctgcacgttacccttggttcccagggttcctgactcgagcagaggcttctggaaaaagacacatcgtcgatcgacgtaggttcgggcgtcaacgttgtccagagcgttagtcacaaagtccagagacttccagaacgagtcgtcgaagatgttctcggtatcgggaccgaccttgtcgagcttggcatcaaagtggcccttgagatcagggttcatctctgccacagcctcggtagcggtcacggacttgtgtttgcccacatccttgggtcggaacagaaactgtcggttaaggttggacttctcaatcacgtcgttatcggtcacgtggatctctccgtcctttccaagacccatgagagcccagttcttaagcatctcgcaaccgatggctccagagccaaccaggaaagtcttaacagcaaaaatcttctcggtgaactccttaccaaagacggcaacctgtcggtcatatcgcgagccggtgggagccacagactgctcagttagagccacgtccttgggcagagactccaaagagtcgaagtagacccactgtcggatggggccaaacttgcccgagcagcccttcagtacctcctgggcagccattccaccaaagagagcagtcatggcgggcagttcaccagcggcctggaaagacagctgggtgagcagcttttcgtcgatttcgcctccagaaagcacgtcggggtactctgcagtgacgctcttggccaggtgcagcacctcgttggcgtcctcggtattctgaggtcggggggctcgaccgtgcttctgctggaacgcctggacggccatgaagccgacatgtagctgtgcgggtcgctccatcttggcgaagtcggaaatcagtaactcgggcttggccagctgctccttgagcgaaccaaacgaaatctcctggggcatcttgacctgggtgaaaagacctcccttcttgtaggtgcccagaccgtcaacagaaccaatattgaacgaataaggacctgtgaccttgatctttcggggagtgtcaccgttgatatcgagaccctcgacctcagtgaacttaacataatctccatcctcaaggttgtgtcgagtctcatcgagagcagcaacgttaccctcctcgtcaataccggcaatgattccggaatggggctcctctccgttggcgtcaatcagagcaaaagatgagccaaaatcgacaaagatgttaccgaaaagacctcgggtgtctgtgctgacaaacccaatattctgcttgtgtgtgatttcgttgactcgaatctgttcttctagagaagcattggtcagcacaaccacctggaatcgagccacctcctcctcggagagatccttggcctccaaaacgtgcacaggaacgtacgaattgagctctgccagtcgaggctgagacacctggtctcgtcgcttgcccacgtcgtcctctcgcaggaaaaactgggcactgagatctgcaacctcggtcttgccggggtcatacagagtcagcgacttgactccagccagaacaatgttcttggcaatctcaattcccagaccctggagacccacgataagaacgttggagttggccatcttcttcatggcctcgtgtccaagcacatagagctgtcgcgagtacagggactcatcaatttcgcctgcgttgtcgatttgcatcttgtctgacttgtctgacattgcaaaagtggtagttgtgtaagtgtagattgaactgtggcaaggaatcgtgtggaactaagtgtcgtcaaccttgatgttgggttagggtaaacggagataatgtggagcaatgaataattgaggacattatatatagagaaagggaggtttgggtttaaggttgagtcataagggccttttagttgcttaccaattgatttgctatcttcgtttgctacatgtttgtcgtattagaagtctttagtcagcaccaccacgctgtatcaaaatcaggtcacccgcagcttacgtaattagctatctaccaaataaacttcgctcccaacgctaaccacgcctgcaccaacatcgtgcagaaatttatttgtgagtttcactatcaaccacacaacactatgactgaccgaagacgagttttggggcctgctgacgcggtgccattcaccctggacaacatcaagccgaccgaggttgagcagaaaagcctggatatcggcagcatcttcgtcaagaccggagtggtcgaaaacgcaaacggatcggcctacttggagctggatgatatcaaaattgtggccattgtccatggtcctcgacctatgagaggtctgttcacaacatcggccatcctgaacgtggacacaaaatttctccctgtctctctctgcgatattgagagtaagagtgctgtggttagctccacccagctgacccaatacattcgatctgccagcaccacacagagctcttctctgcagaagaacgtttcatcgtacgtccacacctctctcctgcccagcatattggtcgagaagtaccccaagtccaccatcgatgtcagcatatcagttctgtcttcttccaataataccaagaccaccgtggctgccgcagtttcgtgcgctggcgccgctctggccgattccggtctcgagtgcaccgatattgtgacagcaggaagtgtgctgctcgatgagaacaaggcaactgtgtcgccctcaagagcacctaccagcgagattgacggagtagtatcctacatggcagcaagcaagaagattgtgggcatgtggattgaaggcggtaacgtgagcgagaagcagatggaggagattttcgacaagaccgaggagatggcccgggagatcagaggagtcatgcatggagttttgttggagcaataaggaatgactggaatgagtctgtgagcatgcgtggaaaacttagtggcacaacatactgagggtgtcataagtatcctcaccgatagaatggttcaccgaccacgtgaatggaggagtgcacagagtcatacagcagctagggtgcttgatgtcgcgtttaaaacacaaccaaccaaactacgggtacataatattacatagataacgcattgaacattacatgttacgtagttgtaagtgtcaattgcggtcaatcaatgtactgtcatcaccattctatctactatagacccctacgtcaaggtctgtagcccgtggcccagaattacacgtcactcgcaactctggtttgtgctcttcacttgatccgatatttgttgacacacacacacacacacacacacgttcttccagatatgctctctgcaaacaattttcaatctattcatacatattcattctcctcctttatacagtaagacctttaagggcgtctctaattctgagcagtcgctcagccaaattctccacagactcatccgattgaagcacctcctgcgccagctcaacgttgaaatacgcctgaacggcagcctgcactctgttgatcaccttgggttcctcaagagcccagtagtcgtccacttcctcaggagggaactccatagatagagagaagcatcgctggacgatggggaggatctcaagagccagagtctttgcatccacctctccagatagatcaatcttaggagccacaatctcgaaaggttccgaggtgctgagcacagtgtgcttgccagcatggtggtatctgaactcgtagactccacactcccagaagagtgtgtcccctcggaaaacaacttctccattggtcttagaagacgacacaataccgtcgagatgcgactcatggccagtctcgtcgattccagaccatcggcccttggagggaagagaagtcacctcaggggaagtgttgtcgtgcactcggtacagaccgatccagtcctttgccgatctgttgggagaagcctgccacttgacatgaatgggggttccaaaggcgtacgaaattcggttggaatcggcacacttctcgccgcccacgagcttcacagagtaatcggcagtgtcaatgttttcgggaacatccagcattcgagtaagggtaagtttggcagggtactgtcgcaacaggatcttggagtcgttgacaacttcgttgagagtaggcttggcaagtccaatgaactcctcgaccacagtcagagtatcgttgataaccttgtcaacggatccctggaactgtcgaacccgtttctcaaagggagaaggcaacttgagagagttcttaatggtcttggtcacaccagcatcgtgtcggatactggtaccgtagattcgctgcatgtggggctgctcgacgaacttgatgaatgccataccctccagagtccacaagaaggccaaaataccaacacctggagagttggtcatcagagcaagaccccagatgccagcaataccgaaaaatcgctctgggttgttgaggtatctgtaaatgccggagtaagtgaggttctgctttcggtcaaggaagaagtcaccgtagaaccatccaaaatgcccaagagagtcatggatggacttcgatgtccagccatgcagagcaataagtagagcgccaagaatgtacttaaggggccacagaggatcggtggaaggagctctccactgtcgcaggcaaaagagaccaaatgtggtgtaggacaacacggtggagacgttgtaccacacttgccactgctcgtatgcctcaaaggggtagattccaaacttgaggaaggtcttggtgaaggatcgtcgctcggactgtcgtcgcagtatgactccaagacccagagtgtggaaaagacgagcagacagagccatgaaaaaagtcacagtgtaccacagacggttggcagggaggaagtagagcagcattgtatagactgcagctcccacagtcatgatatctgtgactcgagtgatctggaagttgctaaacacaaccaacggaggaagggagtgtttctggacagtctccggctcgtcaaaagtagtagaaatgggagtagaggcaatagaaacggactcgtcgccctcaacaatagcagacagctcatccttctgtttctgatcgagccccagctggatggaagatcggtctcggacgtgagaagcctttcgtcgctgcttgggctgatgggggttgtaagtcttttcaatgtgaggattctcaacgatggataggaacacaaactgggcagcgtggccggccagagaggccaggaacagggtgtaggaacaggccatgagagaggcggcgtagaaaccagcgtatccaatggagtacatgggatgaggggccatctcaaagacaccatcaaaagtcaactccatgtccttgaggaagaagaagtctccccagtaccaggcataatccttgacgactcggtgggcgtcagtcttagcccacaggttgaaggctagcattagagctccggcgagccatcgtccaataacaagccaccagggctggttggttctcacggacagagcgcaggaccaggccagcatgaagtagcaggtaaagtctgacatgagaatcagatcgaccacatgtcggaaaagaatccaggtgttgaactcgacgggtacctcgtagaacgagtagttgggctggttctggaaccgggtctcaaactcccgcttaatcagctggtgccaccacgtcttgttgtccttgtcaaacaccttgtatttgagagcccacttggtgagtttgtggtagttggactggttgtgaagtagccagccgattcctccgttgtaggccagacgccatgcggcaaacagaaacagatagagaggtactctccaggacttggggacgacaaaaaagagtcccatgaatgtgaccagaatcgatacgatgatcacgtccgtcagcgactttgtgattcgaggatcaaacaggttggtcaacatatcctccgtctctggcacaataaaagtcgttccatcaggacacttgccaacgtaagcaatgggctcggtggaggtcttttcagtcagcttttcggtcagcttttcggtcagcttttcggtcagcttttcgtcgctttcattctcattgatcttctcgtcaatcacactctcctccacgtcaagcttggtgtcatgtctcttcttgaggtcccccatatccactccggaagccttgatggcagcagaaggaacggccatggtgtttgtggaagctggtgtcgtatagaaagtctatggacgtacaagtgtcgcgcgaccaaatgtgtgtagactgaggctagtgggagatagctcggaatttaaaccgtgactttcatatgctacatatgcggagttacttgtagtgtctggggtaagtgctattaggatggtggattgaagatatttgcctgatgtaaaagattgatgtgtcggacggcccggacgacatatcacgtgactcgtttttttctgaaatactgccttctcatttttgtttcacgtcgcccgggcagtcatccctgtacgactatcttgactcccgaattttactttgtggggagcggaatcttgcatacgtgttatacgctggacgggacaaacggagaagagagcaaaaaaaaagacacaattaatgatattcgtgccttactaagcccccgttttccaagtcacgtgacatccaccgtcccttggccggcgcgcccacgtgaccagaatctgctctcctgccccgcaaccgccccctaaagtcacccaccaccgacatccatctgccttatcagccatgattccaccgcattctgcgtacattttgaatttttcttttgcacttttttttgttgggaaactcccctgctgctgacaagcacatttggtccgagtaagacggatttcagcagctatagcatccgtcagacgtccaatcctgcgactatttaatcacatgtcagccgttgagtagacagagatccactgccaatgtatatgctgacagttcttcagtcatctcgacacttttagcgctcatgtgcccacccctttgagagcagaacgaggcaatacggctaccattcattgggttgcactgcactgtaaaatggcatttagttcaacgatcactcactcaaaagttcggctccgaacagctgtcggcagacactcggcacaaatttcatgcctgcaggtgcgcattagacgatgtacagaggtgcgtgttgtgtttgcggatgacgctcaaagccgctttgaaccagcgcacattcaagcaggtcaaaaatgagcgaaggtcggatggcagagccactacagtcatttgaggagatccacccaggccattaaagttgtgactagcgagactttaggttggtggagttggcgggcggctattttatggggatgcttatgtaagctgggacacgatgggagggggagctggatggcggccgggtaactctggctttgggggagcaagttgggatcgccactaacggtcagcgtcgactgcctcgaaattaagattctgtcacatgaccagtctttattacctcacacataatcgtgcatacaatctactttacaaccaacaaccagaatgaaaatagcttggctattgtttacggcagcgacatttgtggagggtgtttctcgacataaaagagaccctgtttggaccgtgaatcccggccaggtcccggactacgtcctgcgtcactgtccaggagtgcatctttattcggaggaaaagtatctccctggtgatccagcagactatgtgaccaatttcaaaattgacacggcttctggcaagacggtattgaatggcagcgagtctgatccggtcactttggctcgcctcggtcaatattcgtttgagaagcactcttcaaggacatttatgacttcattaacggatttcaacgcagatccggactggatcacaggagaaggaaacatcccccatcttgtttcgggcaagattgatcatgccaagtctgtattgatcgtggttgacaaaggtgatggacttgtggatgccttctggttctacttttaccccttcaacctaggaccttttgtcatgggtggcgggccttatggcaaccatgtgggcgattgggagcactctctggtgcgtttccaggatggcgttccgcagattttgtggatgagtgcccatggtggcggaaacgcctattactataatgctgccgaaaaaatggacaacgatcctgaaagaagggtcttattttctgctcgaggcactcatgctaactacggatctgtaggccagcattctcacgatctacccttttacatgctttcggactttactgatcggggagctctgtgggaccctgttcagaactactacggatacactctgacgcaccgagaacggggcagaaccggagccgatcgcatctggtttgacggccgagtgctcacatcggacggccagtctccacacccgtcgtggctgaactaccttggccgatggggcgatcggcagcttccaaactcggatcctcgacaaaagtggcacccgttcaactggcgatacattgatggcccacgtggccccatggccaaaaacctgctgcgccacacagtctgcgagcgcaacaagtggtggaatttgtttcgaacgtgccgtatccgacgccgggtcgagacagcagaaggcatagaagccgagggatacgggtgcgtgggcctcatggactggcttccgtggtggatcggctggattccgtggactgtcacttggcgaggatacggctgctgggccattgaccgtctttggggttgattgttgagtttggttgttacggtatctgcgagccgatacatcattcatatcactcacaacctaccggtacatactgtacttactgtactgcacacttttcgtacgccctcccctaaccactagaagtcgcgacgttggtgttacgttcccctcccccttttccatctcttgtatggcccagttcctgttgcatcttcttcttgttctggaggaacaaacacctagtcttagaaacctcggctagataattagtatatttatttgttttatagagtggtggaacatcccgtagatactcggcagtttgtgataaaccaaacagcacgacccccttcttctccatattatcaaccctgcctggctcatgctccgccaattagttccagaaattgacaaacaataccaatcagctgaaaaggggcttctgacactgacatttgacgttgatattatcagcgtcaaggggggatatgaggtccgaacaagagtgtcactgtaggtgtcacatgtcaggctgcgatgttgaaacaagcgcagatatgtggactggaatgctacttctcgacttgttcggtctctcgtattcggctcagcttcctcagagtgtctcatttgatcgacgatgcagctgggacccagttgctgtttctacttggagcttgctgtgagtccgattgagaaataataagtgggcctccaagcttccattttattatttgccggtcttttctgagacactgggtcacgactgtcgatgacacagacagacgtcctcgtacagtgcggacttctacaaatgggcatgagagcgagagcgaggtatgtagacagacagacagacagacaggtgagaatgtgggtcaattgacaagaaggggcgtcatggactggagggggtctagactgagagccgctctcctgcaaaaatgcaaaagacgctttgttgacaccgagaaaataattcccacgtgaacttgtcgtctactagaacgtactgtacaagtactgtactggtagattgtccccagcgcaaatctctcgtataatattaccacgatccaaccggcaatgtacttttacctacgggtaatttaatttcaaaatgggatatcaacgggctcgagttaaaattcccctggtgaataatgggcgataatttctgttgactttgttaagactggggaaaacatagacaccacgggcccacactaggccgaaattacgccaagggcctccgtacctgtcactcgccgtcactaaacacacctggaaattacggggaagaaaccgccttgtacagatgcagataaacatccagatccacatttgcaggtggttcagtttggaaccatgcagagcctccaagccctcggtgacataccacgtccaaagcctgtcatggccaccctgccgagcccctgatctatcccccttgagcccccagccccacagtttctttttacacgtcaaggcaaggcacacattagtttgcgaatggtgtcctcagcggtgtacgatacatgatctgtctgtctgtctggccctgacactgacagcctataaacaagagtcgtatataagcattgaggacaaaagcaaattacttgtactatacagcacaagcaaatttcgtatccacattttgaaacctcccacaaaaaacttgcacgctcacgctccctcttaattacaataacacaaagcttggacacatccgcattcagtcaaactccgagaacggatcggaggtgtatagagcagagactttcgggctggaagatggcggtttgtcatgctgactgacggtcggacgacggcgcggtagcacaaggcgctggaaattgtgtttcagggttttatcacggcaactgtcgcctcgctatttttccttggattccgctaatttttcttgcgtcttaattttggccctccagacttcgcctcgtgctggaactttcatgggcacactctccagctgtgcttgagcttaaagcgaatctcgaactttataaccttgttcagaaactctattctattaccctctctggtatacacacagagacactgtacctgcgtggtggtaaggttgggagtccgtgaaccgaggagagcggcggttgtgcaattggggaactgatagaatgcaaaacacagcaacgcaacatcaagacggccgtgcggctggctggggggaggattttttttccggatcacgtgacgcgcactggcggcgaacagcactgccctcgtcgtcacgtgaccccgtgccagccgcaaggttgtgggtgaattttgttaagcagccttttgagttatcaggggtcaatcgacgttacaccgcggctggttggagcgcaacaaggatgtgaacaagcgaaatttcagagggacaagaagacagacagggaaaaaaaaaaggaatcaggaaaaaaaagcacaaaaaaggcaaaaggacaaaagggcaaaaggaaaacggccaaaagacaaggcctccagctccccacagataagggtgtgtgtctgtggtgtgcctcaaaagtctccgacccaggtgggcattggttgcatcgtctgtagatggtgtgagagcagctatcataggcgatacaatatgtacgaaagataccgtatcgtacttggattatcagcactagctacgatactgtacttgcggagtgcttgtcaagtgattgtgtccacttgtttgaccgcccaatactttgggaagataacaccggccctcctgtgtgctcgtaatcgcggtgtagtgtgcagactgtctgtttgtcatctacttgtagtagggtcatgcaataacagacctacccgtccagtgttatacgccacaggggcaagtcatcaccgtcaggggtaacattgagggcaagctaataatagctgctgtgggtggtgtggactgtatcacacctactgctcagagtggaccagtatcttggggccaattccacgcgctcttttttatccctccagccccaaatgaaaaataaccccgagtacagcccacagtagcctcgagcagacaaagaccaggccaatagctaggctctcttccaactaaatcacgcgtgagatgatgtggatgagtctggagacacagaaggccgtgaggggcggggcttgctggcggcccagagtggccaagtgtggctgcaatgttgagtgttggccaccaacgtcagtcatgtcgaatgaagtgaagacaccattaggggttgactctgtcgtgtgtcttgtgtgtgtgtgtgtgtgtaatttggcactgtctcacatgtataagaataaggttatagagttacacttttcaggttgatatttcctggaacgctctttgtcccatcactttatggattttcggctgcatagccaattttaagaatggtacatgggatatgctagtgctccatcttttgtctgctagcctactgccaatcgaagatccatgctttaaaagatcaaacgtctgcatcaccgcacctgtattttagagggagaagaaaaaaagatactcgcacacagacagccccatgaacaacaacagccggataatggtccccatgcactctctaccgtctccgggccagccccagggccccacctcccaccacatgggctaccagtatgtcgagacgccaccatcgcccaaaagtagaaagtcctcctctttcaatcccaaatacatgccgcccctggactcgtcctaccgcctaggctacaagccgctcttcaagcgagaaaacgaagatcctttcaagtacgacatttcctcccctaccccggcccagtctccctatgacgaacgcaagacgtcggccccgtcggtagtgacttcatcgacaacaggctaccccaattacaccaccgagccgctgcctcgaaagaggggctactctgcgccacaaaacaaggctatggtctccatggtacaccacatgcaaccgcagcagacttatcactcgagctcctcgtccagcaactcctctcgagccaccatcaaaaaggcccgaagagcctaccggtccaagttcacccaggagcaggaccggctcatcatcagcatgaagaacgaaaacaaaacatggcaggaaatcaaggaaatggtcaagggcgagaccccccataacatccagcggcggtacgaggtgctcatggcccagatgaatggcaacctcatctgggagcaggacgatctggatgctctggtcgatctgctggaggccgccgagcgacacaaatggaaacacatttcgtccgagctcagccgaaagctcgacaagaaggtcactcctttggcctgccagaaaaaattcaaggagatgtttggagtggccgaaaactcgtcgctcctaggctcctccttgtgctacgcatactatgataatggctggaattgtgttgaataaagagatggaacagtcaaaaagaaaagagcatggtagcaatggtccacacctctttgcttttgaacagtccaatgttcatttctttttgcgtccactcacacacacaatcaatcctaagaatacccttctccaaagaatttcaacccattcgatcggttcccctacccaccaaggtcgttcatcgtctacgagttctctcatcacacgaccctcgtttatttattggtctaataaccgcttctttcctctcatctatgaagccaaaccccaccctattatttctagaccgtatttattgcatcatattctactaaatcgaattcgttaatttcttcaagcgcttccgtggtatcccattgtagagcccgcacatccgaagattgccatgccacaaatttttacccctattttttcgagcccccaagctactcttccgtttacgtttaattaacggctgccactaaagttcataaaagatcaatctgcaaactaaagatgcgcggtgaccgcacactgtacgcacatgcaaagacaaaagtgcttttttgtgcgttttcgtgcatttcgtgcagtgagtgcatttgagacaagttcatggggcatgtatacggtacagcttgtttcaggttgggtccaagacccccataaatcgagaaattcgaccaagacctcaacgggcatgcttcccaagtgtgggaatattatttccagaaccacggtcatcgcatgagaagctgtctgtttgtgagggtcccccccggcggcacatgattggtgtatgttaagatgcattatttccctgtaattttgatgtagccaaaagacggctgtcacccaagcttccaccaagctgccacttgactcttctcatttttaccccctaatatactcacacgcatcctgagttagcacatccgacatgagtgaaatgcttcttgcgcactcaaaaccttgggggaaaggcaattccagtgtgaaaatcacgatcgaacaagtgcaacaaggaaagagaaacaaatcagaacaaatctgtcagaatataccggaatcaccccccccccaggagttgcactcactctaaaggcggatctcactcctggcgccaacagacctggctctcaatcgaatccgcataaatagaatctttgtgcaacgtcatgtgctccctcgctccatatgctgccgtatccaccattatggatttgaccctgtactttcccggctcgatcgtatctccgtcggcttttgaatcttctccggggtggcatcactcggggctacctgaactgggtcgtaactctgcccggcgtatcggtcgtatctgctgtagacttttgtaggctgctcttccctgacagtttctagaagcaacctggccacaggtgtcttggattctgcatgggccagaaatttagacaggtcggccaccattgactaactcggcacgggtgaactgtcagggaggcccactggtttttccacattctcattccactcgggttgctctagctcattccacagcgacttctggggcgcgctgtagacgtcacttgagtggcccaaccttgggctgccatgtcttcgtgacggtacatctgctctaataggggagagggtatctgagacagctgcttctactgaagccagcttcggattatgcgggtgggagtgcgagaagcaggcatccgaatcagagtcgatccacagctccatggggtcgtcgctgagatcagagtcgccagaatcatggaggtagctcttatgtctcttgcgtggtaggctcttacagccagacggctgtttggccgtgttcaggcccctcatttgtttcataatatcggcagatacctgcatggcgtgactggctgtgttgtgtgatttgtctgcacgagagtcgcattgcaggttcggagactcgtgaggagccgtgcaacttgtttgatttgcagtccgtcgagcccacaatttttggcccaacttgttggacagcgttgcaagcagggtctggagggacacacagtcctgctgcaacatacgcagacgctgtcgatcctttgtgtgcagccactggttgtgtttcaagtttccaccctcctccttgtgatccctaagctgtttgagagcctggtctaacgctagggcagtagtatgcggagagtcatgcggcggaggagacccagaagtgacgagaggctcttgtagaggatctggacaactatctgcgatgtgcatcatggtgcgcttatgcgataagtacaggacgtggggtccattgcacccgtatatatactcgcagcgctgtacacactgacgatggctcgttacatagcccctgtggtattggtagacatgacgtcccccggcaagcaacacagctattggtagcaagaatcaatcaatccacggactagactggctagcatcggtgctaacatggacctggtgccacggatagcccttggcacaaggtgaaacacgactcctaaactaatctcttagtttgtgcagcctacagtgtgttccagaagagcgatactgtatggtttatcgtgtagaagaggtatgggtgtgctatagagagcggcagatagtacatacaagtttggttttgcttccagccaagtgttgcgagacttgttctttgccaacttccttctcacttattatctacaaccacatgagcaaggactgccgaaggaaatatcccagatattataggaccccaattttcgcatattacttatcctaccttggagtacatctgtcagcttgtcggattgcaaaacacatgcagcctatccgctagactggcactagtaactagtctgcgctaaccctgcttatatacagggactaagtagttgagagacaagacaaagtcaagcagcatcatttattacataccagtcagctacgtaattacgcgtacttgtagtgccgtcactactaatactgtaccagtacctgtaattaatataataaatccattttctaataagcaataatctacaatacatgttatgttgtttcgtgcgatatgcaattgatcactgagatcgacattgactgctgctcaggttgttggcagtgtcaatgtagtctgtgatgaaccgaatatttcccttgacctgtagctgctgaggaccctcgtaatgccaccaggtgagaatttgcgtgttttcgtcgtactcccacttgcctgaagacgtggacactcctgtggcccattgcaaaaaatggtagtgcggcaggtagatggtggtgggcaacaacttgccctcgcacttgtcattctctccacatgcagctcccttgatcttcaaggtgaacacagacttctgcaggtcgaagccatacgagtctagcttgccggaaatgacctggggacaaggacgaataaaggcctctcctgctcgggctccaagcacatactcgggaggaggcttgaaggcgtcgccatgcgaggacaaaggaacagccgcagtcttgttacgacgtcggatagcgcccttgatggacgagactcggcctttgatgctctttccgatagacgtcttgccgaggtacgacgaatccaggtaatacgacgcataggaggtatacgtcggaggaggggtttcttccgaggactgagaaccatcggcacttccgtttgtcagagtctgggtagctcctccgtacttctggagctgcttcgcagcatcgtccttggagtacaaagatagatcctctccattccagttgtcgccccacttgtggttgttagatgcggtgtagacccacagagtatagtgcagtttggagccttccagagcgtactggttggcatccagagctcggatctgctgtgagtagtcgcccgttcggtatgcgtatttgtcatccatatcgtaagggattccgatttcggagatcagacacgggaaatttccaatcttggcaagaccctcctttcgcaagaaccgcagctggtcacgcagacaattacgaatggcagactcgccgactcgaagacccagaacaatggaaggatacttgcctcgcagaataccgactacatcgacgttgtacagccggttccactttttgttcatcagcgtcaggccgtcgtagtaatgcggcgagtacacgattcgcttatcgttgaactcggggtggttgacgagatccggtggcacttgcatgactggggcctgcatgagaaccagccagtccttgttgacctgacggattgtcgccaggaaggcgagccagtatcccagaaagtacttattgacccacacttcttcatcaatcttggatccaatgccgtggaacgagtggccatcgttgaagtaggtgggtttgagcagcttgccagtcttgggctcccagacgccgtgctgggcccagatgcacattccaggtagccattcaggtcctcgagtccatccgtagatcttgtcacactcggagaagtccttgagccatgctagagttcccttaggctcgatgacgaccgtgccgttctttgtggctccaaagggtccaaattcatagttgtccacctctacggtctcgcccattcccattcgcatgcattcaaaggcggtgggagtgggtccaagccgcagcttttgcgaatcgggaatggcgtggatgttctcatagccaatcagcccgtggttgggctcgttgacggactcccagccaatgaccacgttctccaccagatgctggtcgacggcaatgcgctcggcgaggtggcgtttggcagccagaaacgacccctgcaggtagtcctggacgttaacgccgttgataatgcacttgggggcaaagtggttgcctgcaaagaagagtgtgaacatgacctggcacgcgagcttctggtagttggtgctccagatcatcttagggaacttggatgggttgtcccacaggttttggaccagggcagaatgggtggtcatgcagtgtcgggggtctaaaccggcagcatacagggtccagaggggagcgcctgatccgccggtgaaacgtgaccacacgtcctggtgcggatccatgaatgcaaacataccgtgttctccaatctttcggagcacggcgatagtgtaatcgatgaattcttcatcgtagactccggggccttcgtgttctagcgcctcccatgtgtaaatgtatctgatggtgttgaatccccaggccttgattcgggcaaagtgttcgtctgcttcttctagggggaaaggagagcccacaaaagagactgttgtgtcgtagaagtcgtctccggccttttgttgggacggtgtgaacggttttgcaggaagcttggcgtctgctgccacgttgattccccgcagaatcacagcttttccggacgggtcggtgaagttgcccgtttcatcgatgagtagttggagactcatgatttagatgttgattgatgttggagctaggaagtgtcttggttgatgttgatgctaggaagtggcccagtgaatgtcgtgatagtgcgtctagtggcgcgtcgagtggtggttcaagtgatgtgggttctggtacgggccgttgtgtaggtagctggcttctcgccgtggaatgtctcagacgcgtgatagagacaaggacaagagacagacaagttgaggctcgggttgagcgagataaatcgcgctggcttctattggcggggtacggggtctgtttaggcagtgatcggcatggacgatgaaaagcaacaattcaaaaagacaaaagtctgctgtcttcaagagctaccccaccctttttccccactgaaagctgttccccccgaactttgtatgagtcgagcggcaggggttttcctcgtgacaaatggcgttgaagataggtggggtggtgcaaaattcgactttgaaggggtttacagggttggaaatttattgacacgaaactatgagcacgtgatggctcatctcgcgactctcctcgaacgattactcatcaataaccccggaagacccgtcaaagtcgcaaatctcggacctaaacctcataccctattctgtctctttcacatgacgtcatgcacccctaaagtttaacgtcactgggcacaagcatgttaccgcgccttactgtgggttccaaagaagttccaaacttgatccatcgtactcgccaatgcccaaatacgttatcgtgcctgtggcgtcggtgggatgcggcaagagcaccgttggtaagactctggcgtctgtgtgtggctttggacaggtccaaaacgacgacatcaccggcacaaatcgacgtccaaagtttctccaggccattctggagcagctggaaagccaccaggtggtctatgccgatcgaaacaactcgtcggtcaaggagcgcaaggagcttgtagacgggttgaggaaggagctgggcaacgaggtggatatggtcggtctgcagtttgtgcacaatcaacagacgattccagcgctcaagaagatcacacaggagcgggtgtttgcccgtaaagaccatcaaaccgtctccaccgcaaccctggcgccccagaagatttacatgattatgggagggtttattaaacgactcgagccattcacagacgcggaaaagaaggaatacaaacttatagtggacctgccggtggagaaggataacacggctgacaacgtgctcaggctgttggagaagattaaggataactcagccaccgctcccatgcttgaagaccccaagtacactgatcaggaggtccgagacacagtccagaacctcattgtcagtgaaaccaagtctgaagaggtgctccagaaggaaaaggaggagagagaaaagaacagaaagcgcaagcctgccgataaaagcaaaggaccccggaagaaacagccaaagttgactttcaacaagggtgccaagaaggacttagataagagctccggcgcttagaatagatgttgtgtattgtatatagatgtcgcattttgaggtatgaccgatgtaatagtactgttgtagcacttgtacaagtacttgtaattgtgatttgctcttcatggccatttccagatcgcttgtcacactacaatatgtcaccatacacatccgaaacataatgcataactgtctcgtataattgaaacatgatatattcaacaattgtggcgaacttttttataataatatatcttaatagggcactacgagtggttctacaagtacaagtacttgtccgtgtagtctccgatctgtgacgggactccagaccaagatttctgtaaggatcacatcacttgacttacaccgtcccaacaaaagcaactacaatacagaatttactgagacaagagcgttggggcgattgtcgtttctttctttttatgtatattcaccccatcgatcagctggcctgtcatgtgtctcaaatgcatagacggacggcagagacgagggtatgacatcattgctccgaatcaacagtatgcactcggactggatctgtctcatcacccttttactgtacaatccaatcgaccttgttattccatttgtgtcctttaatgcctatccttctcattgtcacagtgctacttgaaccccttctcgagccgcagaccctcgttctcctccttgagctccatccattggactccctggctctctcgcttgacattgttcaccgtagagctgatcaccagaagagaaatagcatcgtagcctcctgctccaggcacaacacctccaatgactccactataagtgttgcacttgttgagcaatgcagactgctcatccggctcaatagcagcaccagtctcccgtgtcatcttcttgagatgctttcgaatagtgataatgcatcgtgctagttctccgagagggttctgcaacattatcatctttagagcgttgagaggagcagcctcggccaaaagttgttcgtaggcctcgttgttagtgagagagagcttgcgcaggtcgttgaacaacttgaccatgagcatgttggcagcgttgagatctctccacaccatctcggcttctcggggctttgcttttcgccatgccatcaccttggccaccatacctggagtctcagatcctccctggacgtctcccataagcaggctgattcccggcggcaagaaggatggttccagagtcaccttccacttttgattaacggtagttctcaacagagccccgtattcggaggtcccttcagctgcaatgaccatgttcacggactccgccgggaaacgtctatagactagagagccacaaacggccgaagccacgtcaaatccagacccaatcttcttctgtgccgagcagtgtgcaacctgggacaggttgtgaacgaggtgggtgttatgcaagggatcaatgccgtatgacttgagcaaagctgccacaagaacggtggtaagagcagcggagctaccgaggcccgttttaggcacctcgtggatcgcctttttgtggtatgcaaactggcctctctgcgtgctgtcaatttgcgagtggtacgcgttgtcacttttgatgctgatgttgatgtggaggtttcgaggaggaacgtaatgcagaacggtgttgacggccgcgtgagcaaatgggttgtgtccgatggccgtcagctggccgttcgtgtagttgtaggtccattcacccttgtcaaactgcggagagacgacatggacagaggtggtggaggcctcggaagccgaaactgtcgcgtaaatacgcgccgagaggcccacgacgtatgctgaatacgccggatcaataaccaaataaccgccgcaaaggagggcctttcccggagccgaataggtggtcatttcgtgtttgaagagccggtcgaagatcatgttgtttcgggacacaaatataagctatagggagatttacttatggggtagtttaaataaattaaggttggtgttccagagtttggatttttgacgagtcgaatttcgcttactaacgttacaacatatcgttacattcggtaaggaacactcacaccatatcaccaccttcggtatacaaaaatgagcgaggaaaagtgtcccgtcgaccatgagagcagaaaggtctgggcacgcaagctggagtccagtacggaaaacgccgcctccgggacagctcagcccaaggagtgtcctgttgatcacacaaagatgaagaagcccgaagtcgctcaaacagaaaccaaggctgcggcggaagcctgtcctgtggatcacgagactcgagatgtctgggtcaagcgtcaaaacgtggcctcccacggtttagcggcttctgtagatgtggagccttatggaaacgccgccttgagcgagcccaacaccggtctggatcagcaacgagagatctcgaccatccctcgagctggctcggactctaactgggtgtatccttctcagcagcagtttttcaacgccatgaagcgcaagcagtgggatccccaggccgaggacatgcagagcatcgttcctattcacaacgccgttaacgagcgagcatggtacgagatccagcgatgggagggccaaatggccgacaagtgcggtggtcctaaacttgtgtcgttccagggcgactccaagaaactgacgcccaaggcccggttcaacaactggtttctgggctatcagaagccgtttgaccgtcacgactggaccgtggaccgatgtggaaccaagatcgactacgtcattgacttttacgagggcaagcagctacctggcatgattggcatgccttcgttctacctggacgtgaggcccaaggtgaactctctggaaggtattcgaatgcgaattgccaatatctttggtttcaagtagaacgctctcgaacgacaactactcacgtaacttgtaatatgtacataatattaatacctaaggggatctatcatcaactcgtagctacagtattgctagcaacccacgattggttacataatcaggtagctaatcacgcacattcttcaaccttctacaacacgtaatagcgctgcaatgtcatcaattgaagtgccagggggccaaataaaccatcgtcagacgtacaatctcatggacttttattctatgtacatatttcacatttagggtcggcccatgaaggatccgctgcttccaagcttctgcatgtactgtgttagcagtgtcttccaatccataattgccatccgctcctctcatactcacctctccgaccttggtgttgacgtcaaagtacttggcgacacatcggtcgagacacagaccctcgttggcgttgaggtcgccggaagagtagtcggccttgatgcacttctcgtggcaagactcaaccagacggttgaacatgtcggtgaccatgtcgagctcggcctcagcggcgagcagcttctgggggttgctaggtccgttagggttctggcctccgagtccaaggaatgacattttgtgtgtagttgttgtggagttgatcttgaaaaaaggtctgcgaagtttcgtcagcaactaaaatttgcgagggttaggtgaggtaaatgtagtgttatgagaggtaggaaaattgaaaacagagtttgggataattgggggtattttaagagaggagttgaatataatgaggacaagaaaatgtcgctcataacctgtaacaaacccttgatagcacagcccacaacccaaaaaaccgcaagaaattgcggcccgatggtttagtggtataattctcgcttagggtgtcctaggcaatttgcgagaggtcccgggttcaattcccggttgggcccaaattcttctttcatctcccggtggccaagctggtttaaggcgcgagactgtaatggtatcatattgtaatcttgagatcgggcgttcgactcgcccccgggagattctttttgacccttggctggggttattgtttttggcctccgagacttggccagtgagttctacagtctcagctttccttttcagctcaccatctcaaccgtttatattgtcacattctggcgatctaaaatatatgcaccagccacgtgtgccgtgcatattctttcgcttagctttgtggggttattgtgggtgattaagagtgtatcttgagatgagagtaattggatgttgtttctacaactgagacgattcgattaatactttttttctttctatttcccatcatccatcatcccgtcaggaaggtgttaaaaaagatcgctcaaagcgcgctcacttagagttggcgatgaccgacaaaggtgaaaaactggagagcagatttgaggtctttgatgggttgttttgatcgatttttggggtggaatacaaaaaggaagacccattctcaatccatacatgtttatatccttgtaactcgccgaatacgacttgtatcatcccactacgaaagtagaccctgaaaagtatatgaagagagggggcacgaagagtgcatgaagatggtgtggaattgtagcgttgatagaacgtagttagatggtaccgtgacatcaaagtccgtataagaccaacactgactcttaacctctcttaaaggctcaccaaagctcctctatggcataaaatccctctcaaacgctcaatacaccacccttgtagcttccccagataattacagccacgtcatgtaaaacaaagagggaccctaaccacatgcacatgcaactaaatagtaactaggttagtaggcgcgtacaagtaattaagcatttggaaatcacacacgcgatttcatcattcttcctcacaacacacacatccacacatacacgatgaagctgcccagcctcgccacaattgcatgcctagtgctccccgtgctggccgactatgggctgtcggaaatgtacgaattgtcgctccccaactccatggcatccgatgacagattcaagacgcatttctatgcctctggatctgccgttcttacaagctctgggccaggcggacggtctcagatcgcgctgaccgagctcggccgacctaaccagcgaggagccgtttccggcaaccagcccatcccctccaaggacttcatcactgaggtatctctggctgtctacggacccgttctccctggaggaggattcggtatcttcttcaccccccagccctaccagagcggtcccgtctacggcatgaaggacaagtggaacgggcttgctctgattctggactctgtaatcggtaacgatggagaaggccatttgcatgtccatgacaacactggtggagactacgccgcgatggacgcctcccaggttgagaaggacgccctggcgctgtgcaagctcaagtacagaaacaccggagcgcctgttaaaattacaacctattacatcaacggcaagctcaaggtcgagatcaacggtcacaagtgctttgacgagcggcctgttgctcttcccgactctccctacttttccatctccgctgcttccaccgagggacccgacactttcgaggtctactctctgaaaacttaccgggtcgaccccaatggtgttggaggagctcccaccgaaaatacccctgttgagcagaagcaggaggctccccaggctcagcagcaacagcagcagcagcaacagcagcagcagcaacagcagactcagcagcagcctcctcagcagcagcttcaggatgttgctacctcggaacacattactgagcttgccaagaagctgatttctgtggaagaaaaactcgagtcgttcacggacctcaagaagctgtccactctgtcaaatgaccttgccgtgctcaccaaccgcatcggagtcatggatcagaagctgcgggaaatggaggtcgagggcaaggagcacgtccgggagcgaacccaggacacaaagaactacattaccaaccacctacaggaaatcaagtcgcagttgcactcgctgactcagacgttcgactcgcaggttaagaacgagctgcggtcgcagttcactgacttttcgtccgacaagaaaaaccagatcccctctctgtggatccctctcgtcgtcattgtcggcgcacagtcggctctcttcttcgtctatctcaagtctcgaggcaaatacgaaaagttgctttagggatggagacggagagattaaaaacactgccttgtaaagctagtaatgatttttgttattgtatcatcagaagaaagtagcggctataaatttaaatgttacaaacgtacacactgtgcgagtgcagtttccccaaatcatcaacaactctactaccgtatcaatacgaattctcggtgttatccacacacttctgttgttgctgcatccattaccccaacactcctcgttgatataaacatagattattgttaaatattgtacacgttagacgtaggtctttctgtatcacacctactccctcttttcctggtctcccctttacataaagttctggcctctccagcccccgccgttcacctggggctggccctgaaactgctgtggtggcatgggcatgcctcctggctgcgccatgtgtcgtagttgctgaggaaccatcggagccccacccattcctgtagcggcaatctgacgctgctgattcaactggtggtctagaggcagctgctgcatcagatggtcaggaataccttgaccaggaaccataggcattccaccaggtccgggcatggcccgcttgaatctgctcttgggcgacttgtcctgcatggctcccaggggcataccaggaacacctggctgtcccggccctcctgctgtcacctggccctgtgctgcggcctgcgcccgctgctcctgggcgtacatctgctctagatactcgtccttgctgactcccatgggcagttttcgaatctgcgggggtggttgtgactgggtgagctcctcggacacgtcctggaacgtcggctcagcctcatcgggcgccacagacgaagatcctgaatgagtgtctaatgaagtcgcggctgtagaagtcgacagaatacctcctcggccacgtcgcttctttgtgttgacaatcacagcctcctgctcgacactctcttgctttcgcttcatcatctgggtctgcgaagtggcatacacctcgttagcgtcaagcaccccaagattgggcttcgagggcagttccccagcgctcttaatctgccagaagttcgtccacatgtcttttcggaatttgcgctggccgcccaggtaccggttatactccagagctgagtaagacgcctcgatttcgggggccttgtagtcgtggaaaaagtcgatcgacgcaatgttgtattttgacgccagcgagatattaccttgctggtagtccagagaccctcgaatcgaggtgccgggcatgtaggtggagagcaggaggtttttgagatttgcagtttccacctgggctgctgcagctgccgcattgttgatgggttggttgcttgagtcagtggccagtatggccggagcggcaggcacaaccgggcccgcaccacccatcatctgctgcgattgctgtagctgcgcgtagacgtgggggtgaacgtgagctggggtctgcagcgagttagcagcagaagctgccgctgaagcgcctggagggggttgtccagccatgggatgcagcgtgttggctgtgttgggtgcaccaggcatgcctccggatgaaatacggggcatagtagacgacaacgaggggcgagtcgctggctgtgtgggcacaggtgtgggtccagcagggggcttctcttttcgtttttgggccttgggcaggttaggagggttgggggtgccgtagacctcctggttgtagacgtgagtgatctggccccgtcggtccataatcacagggtccgattcagtgaagccttgctcgatggcagctgcctcccagtagtcatctgtgactcgctttccgtccacaatagcacgtgctccaaactgtcggtagattgaacgagcggtaatgattccaatgacacgtgatcggaacgagtagggaaggagccccagcgcaatcagagcctccttgtccttctggctcgcaatcatcttgtaaagactcttgttcttgttgaacaataagtacgagtctcgaaagttgagctccttggcgcactcggtggccatcataaacagcttcgatccgcgtcccggcagcttgaacgtgttcatccggaattctcggcctccttggggtcgtccatccaggtcgattttcttctcgccttcggggtcaaactccgataccacgaactcgtcgccctcgggagtcaattccgaaaggaccatcatggccggcaattgaagggttttttcgagcgccattgcagatgtgctcactcggctgtgacgtagttaatgcgtggacctgaacgcgtgtttggtgttggtgatgatgagcgattgagggtatgggtgggcttagttgatttaaagttttgacaattgacacgaggagcccgacaaaatgtccgccagggagacactaaagggttgcggtatgtgaggttgggaagatattgttggtggacaagaatagtgcccttgagccgtatgctatccaaacaccttttcttctacttcattcgaaacaccaggcagtttcagccagcacactctactcggtcctgagtttgctttgtggaatgtcgttgtgtgttcgattccagattgtgttgtaattgccgttggagtgctgcggaatgagtgatcaatgcgaacccgtttccatattgctattaaaatacggacacaaattgaagttctccgctcctataaatgagcccacaaactcagaccatgtccctcaacatcaacctcaacacaggtccacttctacagtaacatcatggctcgccaatctcgtatttttagcacgtaagccgcacaacgggtgattgtggcagtggttttttgagatttctttgataaaataattcacttggagccattgttagcaggaattagcacaccgttatacatgactgtcctgtgtatagcctgcggtgttgaatgatggggaggataagccgtttttcgacagaccgagaaggtttcctctgcagcatttctcagccttccatcttcaacatgccagataccgtgctcgaaattttcggacagcctcccctcaatatttatacccaaatatgtctatgttacagcatggataaggcacgtcgaagcgagattgtgcacattttacaatccggtttagtcagattgactgaatccttcccatggatagctggtcaagtggtaagagacgatacctctggcttattcaaaatcaccacgcttgggaaaacaccaagactggttgtgaaagacgtcactgatacagccctccctatggaacaactcaaaaatgttcagtttccgtttcgaatgatgcacgaaactgatctagcacctcgaagtacgattccgggactgttcagtgagtcagagcataaccctgtgtttcttcttcaagccacttatattgatgggggtcttcttttgacgtttctaggtcatcatcaagccatcgatggcactggactagcccagatcgtgtctctattgtcaaaagcatgcaatggagagccgtttactgaggaggagaagataatggggaacatggaacgtgataacattgtgcctctgttttctgagattgaaaggttgcggtacggagacctttatgagaagctcaaacatcagatcgtgccaaagtacactcccacaaccagcgagaatccaccaagttgttcatggagatacttcatcttttcaggtgattctctttccaaactaaaacaacttgcttctcaaaatctgacaacaggcatcccattcgtatccactgacgatagtctcacagcctttgtctggcaagcagtatcacgagcacgacttcagagactcgaaaagaacacaaaaacaacaatagggagagctataaatgtcagaccatgcctgggtattcgaaacacttatcctggaatgatcaccaacatggcttacagcaataatacactttcggagctggttgatgcccctctgggtcacgtggcgtctaatctgagatcgaaacttgactctgaagagctgaaacaaaataccagggctctggctactcttattaacgacaatcttgggactcctattacctcacctactgctaccatggacatgtcttcagatatagcgctgagttcctgggcacagcagaatttctacgcgctggattttggactcgggttgggccttcctgaatcagtaagacgtccagaattcactccagtcgagagtctcatgtatttccttccaaagacaaaaaaaggagatgtagcactcgctatttgtcttcgagaagaagatatggaggctttaaggaaggatggagaaatgatgaagtatgccacatttatagaatgatattatggcttgtacagcacttatacgacgatgtgtgttttttttttatatatatatatatttttgttttaatttgtaacaataataatctactactcaactaaacttccaactatttccccaactaccataccgctgacttttgtcctattgtgatgatattaaaaaaaattaaaaaaatatgtgagcgttattttttattttactttttgcctggtgcggctaaaacccaaacctccatacactcaggtcgagaatatttttttagatatgtaaatttgtcaaaaaaaattgttgtgttgtagaagtagtaacgacagattatatatacaatcagaccacgtaatatctccagatacccccagaccacaccgatatttttagagtaccaccaacccttctggatcgccttcaattcctgcatttcaaaattgccacccgatcttcttcatatagtattagcacactgtatggaccactcagatactgcatattctcgatgactctctttgaaacagcttactaaaaatataaaacagaaacaggagctccaaagaccttgcactatcatttcttcaaaaatacccccacaaaatctgtcagaatcccaagccgaattccgccgttgagttccccagaatttccatcagactcattttaaaatcctgaaatgaaacgcaccctaaccttggtgccttagaatggagaactacgtactctacgatagttgagggtgtaatagtacaaaccgggaagacagttgagagaatattacttcgtatgactaaaccccctcgttatgcacaatttcctttgtggtgccctaaatacgactctctaacgccccaatcacaccttccaaaagcctcacgcacgtgaccaacgcaatcaaacattagaatgcatacttttttttctcagacatccaacctctaccaagaacaccttcatttcagcctaaagcgtcttcaagctcccgtcacatcctctattaccaccgtaacatcgacaaccccgaatcaaaatacaccttcaacgccaccagccaccacccaattcacaaacactgtcacagcagtcagtaacacaaccatggcaagtacacctcgagataactcggcaagcccgcaatcgtcccccaaacctgtcctggtgtcgcgcaaaagcatcgtgtcttttacagaacccgtgcatcccaatgacagacacagaaacagcgtggtgtctctgcatcatatagatcactccaaggtgctggaaaccaaccgaagagtgagtcccacgagctcgaatggagcttctgggtgtaccactcctaccattgtcaagggacggctcgaaacgcaatctctggacgagattctgggatctctgggtgacacacacgctgtcgcgagtcccaacttcaacctgcactcagtcacgagcaaccccaatctacctactgccagtcccacgctgggacccaagaccgtttcttcggctcctgtgataaaacctgctgtttccacgcctgcaactgcttctcccactctcactgactcgattttccctccgaagaccgactcatccaagatccatattctaatcgcagcgtcggggtctgtagcaactatcaagatgccactcatagtccagaagctcaagactgtatacggagacaaggtggaggtacaggcgattctgacaactgcagcacagcactttttcagcgcagagcaacaaaatgaaatgatcgatctcggggtgcgcatctggaaggacaaggacgaatggacatgctggaagaagtcgtcggaaaagattctcaacgcagagctcaaaaagtgggcagacgtgctgctcatcgcccctctgtcggccaacactctgtgcaaaatcgccaacggcatctgtgacaatctcctgacgtctataattcgagcatggaacccagcagcacctatcattgttgcccctgccatgaacaccatgatgtacaaccacccactgactcagaagcacctgaatgtgatcaacgcagagatgccctggatccaggttctgttgccagttgaaaagaagctggtgtgtggagatacaggcattggtgccatgttggagtggagccaggtggttgactgtttggtcggtcgtctcagcgagtgacagttgtgtatggaccactactataactgcaatttgctatgtgctatctgttattgatctctgatgataatatatattcatttatttcgagttgcaagggtctaaacagactcaactaagactgaacatcatacttgatagcgcgagaagttacagtacatacggtgtacgatacatttgatgctgccatcgatctgcctgtataccgtcagttctacttgtgtgtctatgatactcgtcgagtcattcaaaagcattaatattattcaaccaacagtctaatttttgttgttcgctgtaaacttcgtcactttgtcagtctccagtcatcttgcccataactggagagagagtgtgccttatgttgccaccgtgacctggctcaaaggctgtggggtgagatgagtcgtacaggaacgagaagcacccgtcattacagccgcttcaccggaacccggacccctgtcttgtccaagtatcccagctgcaagtattggcgagagtgatggtgatgttttttgggggatggtttttttggtggagggcctatgcgaaacagggacgtgatcggagcggcctccgaaactccgatgaggaaaaaagacgagtcgtcagagggaccggaccttatatattggcagacgtgtgccccaaagcacaacaatgtgcaattttcgtctcaattacagcttttggctcaattccacatgcatttaatatttgggccgtgggatgggatggggtgagaatatggggcaaaattgtgaggggtaatatacaaagcttttggagctggagaaccatgcgccgggggtgtacacgcaggtttgcagacgcaggagtggcttgttgcagtacgggctgtgtattaccgacttgtcaggggcgcacacctgccagtaaatgttagtgtcagagccgtatgacttacagaacactcacttgtgtctcactagctacttgtagcgaatatgacatcacctcggcaataataagaacaaactagcgtttggaggttgagattttgaaaccgttttggatttggaaaaggttcttgtcttgttcagatggttatctggcgtgtgtgtatagtctgtacagtagctagtgtgcatcgcacacggaactggtccgagagctacgataacaacaaaagttgctgctaattcgcacctgcaggcgtacatgtcgacattaaacactcatatagcgggcaagctgtatacgccagtcgtacacttcacttgtctcagcggttccttgtgctctgcataatctcgtatcccaagcttcatttaataataatcccctacagccagccacctgacccggccttatcaggactattctcttgtctacaaaccttgtgaattatcatttaacggtttataatacaggcatggggctgtgtgggtggttcgtggactgtatacaaacaaaccacacctgtaatatcagcagttgtggcctgtgaggtgagtgcaaggctcccgtgtgaggtttgattgtgtccaaatgaccgccggtaattaccccagctctccagtacgtacagggctcttcctggccctaatcaaacttaccatgagccgtgttaccaatgaggcaaccgtgtagcccgaacgatgagtcgtcatgtgcccttttgccacatactgtaatttcgtattggcctcattaggcgtagatatcggatatgtcgggggttcaattgtgtgtgtgtgtgtgtgtgtgtgtgtgtgtgtttttttgtgtgggtgggtgtgtaccacattcagactcgaaaagaaaaaaagtaaacaaccagcttcagatcatgtatacccgatacctgaggtatgactcgtatcgtatcgtacttgtaccggtacatccaacatgccacacgatccaccgcctcgaacactccacgtgctctgaaacataataacttctacaagtacgagtatctcatctgtcttagactaccgtaacacacacccgaagcactttggacttgattgcttcctgatatattatattgcatcccattaaggctggctcttctgggtatccatgtcagcccatctacaagtaggaaggtctctaatttcctttacagctcaaacatggaccacacaacgcacttccctgctacacttgcaaatgaaacaccttaacgaaaccaatctctaagcgaacatggtgatatttgtaagcactagcagataattacgcggagtaacaaatctcgaaatcacgcaatacagtacaaccatctcattttacttagttgcatagagtaaattcttttacatcattctgctgaagagagagatgtgctcatatggtacgatactacagtatgtatgtactgtagaagtaccatagaagttgtccagtcgttatctacgaccacccaagcaaaccatagtcagtcccgtactcgttccctatcaattcatattaactacttgtactcctaaatctcatcttccagaaaatggtactcaaactggaagttggacttgcgtcgctgcagccacacaccctcaaagtcaaagtagcggtaggtgccctgctcaaactcgttattgatcatcttgggctcctcgtggcgctggaaccacgtcaggaaccgcttgtggaaccgccacgaccgcgacttgagttccttggccgccagatactgatggtacgttccctggcggtagtagaaaatgtagaatagcgtatcgatgtccattttcgcaaaaatgccgccgtcctcaaacaccgccagagggtcttgaggatagaatggcagagtagggaaaggcgactcaggatggtacatttgcggcttctccgcgtcgcctgagtctggacacgaaaagtacgacgtctccagcaacttggcaatcgagcctattggtggaggagtgccgactcgcttcttggccacgtccagcgacgacacaaggtcttgcaggccgggaggaagcgtgtagatgatagagtcgtccgacagagtggtggacgtggacaggggaggcggcgaaggtgctgtcgatgtggtgttgcctgcgctgcttgtcgaggctatggtggcagaggcagccgggccagtaggaatagcaggagcagccaccggtgtagaggaagcggcaatgggagtcgaagcagcggcagggccggtaggaatagatacgttggctcctccaggtgcaggacctcctccttcagcccagggagcaggagtggcagaaacggccacaggcacaggcgcagcggctcgaatttcttctttgggagctggcaagggagctaggccctgtggcaatgcactcggagagcttcccacactgcttccagcagcagcggcggctgcagaggcgtacttgagcgactcattgcgggtcggcagaggagcaggtttcatgttgcttccgatcggaggaggcgtgtttgtggctgccggacggcgactgctattctgagcgtctgccgctgcttgtgctgccgcctccttttgtgcctgggccgccttggccgcctcctccttctccttggcggcttctcgttctcgttccttggcactttccacagccaaatcttccagcgtcgacgtgggctcgtccctcaggtactgctcgtcgatggtgaactcgtcctcctcttgatccagattcagctcatcgtagatttccacgtcctcggcgaaatccacatcctggttggactccacgtagtactgaatgtcttcctgaagatccatcacctgttgaggagccaaagatccattctcaagcagtcgtgcaatgacttctagacgtccaatgtgccacttgtgtcgatcgctagcatcagcaatctcactaagacgctcactcttgacactgttgtccttccgaccctttcgaaccgtgccgtgcaattgctcctcctcggcctccaaggtctccaattgctcactcagctcgtcgatcgtgttttgcacaaacgcacacgcctcctgtcgttgctgttctcgcggatcaagctgcttgcctgcgcctggactcagtccctcctttgaaaatgccttggtcttcatctcccgctcacaggccttgaaccgttccatttccgtctcgatcagcttgcgttggtccgtcagcgtcttcttgtccttgatgtcgttggaacccatccatgtcttgatctggtctcgtaatcgctgcagctttttgatctctcgcttgagatcctgctccagtttttccttttgcgactggttggtcgactgctgtactttgtcgtagatggagtcaaaggtggccactccttcggccacccgcttgaacactcggtccatttcctgctgcagttttcgcgcagccattgtagagatgttaccgccgagagtatttgttggtgtcacactttctgcatgctggagacggtgagctggtatgaaaagtcataaccctaacctggagtttattcggagtggagagagaagccatatagtggtgagtagaatacgcaagggggagtacttggatcgcttttaacaggcgtttgatttgtgtgtgtcgtcttttatccttaaaaattccttctgttttacccaccttataagtccctaagctacagtaacacccatatcacaaggtttagagaggagttcaaatgtatatggagatgagtatggagaacatgcgccatgtgtgaatagttgcagcctgggactggtatggattctacgacgacctcatcagcccattccagtaattggctcactgctacctctccaacagcacctacatcgcacactttacccctcctatctcaagtgccacatgctacaatgtagctactctacgatatagctactgtaagcttaacacggagataacatgagggagttactgatagttgttggaagtcatgactgtgtatcgtaggaaagaaacatggatctttttaactgtaatcataccattcatttcaccccctgagatcatttctagtctctcaaacgatgaaacacgtgatgttcaaagttcgatgtcacaccgcaagattctgttagggcgggaaacataagagtacctacgagtaggctacatactgtactgtacctgttaaacacaacttgtgagtgagaaacttgctaggagcttgtggggattgttcttgcggctcaagtactacaatccggccaatccaacaggaacccacaatattcctcctctacgtagttcgaccatgtgtatgacgtcagggggcatgcttcaatagaatgtgttacagagcccataataatgagactgcaagaagctatgattagtctgtataaaagtcaactgttccactcattgagaccacaacttactcccattcatctccctgattcctccttgttgctcataatctgtaaccgtgtctcaaatttttatcactttatcatttgataccacagccaaccacagcctgtcattaatgacatcgctctgcacatcaacccaccttggagatgtactgtacgagtagcggttcaagccttgtccgggttggggtctgtgttcacagatcaggtttttcagaagactgtagggttagggtatagttggggtgcggagctcgtggtatgatttattatgtcatctgcatttgcagtgataatatctataggtcagtaaaatcacgtgaccattttctttgatcaccccccatcagctgcactccactgcagtatgactcagtgcacctgtctcgatataaccttccaaatcgaaagcttgcaactttcggttttgacatctgtttgaaaacttgtctctacaaaaaaaaaaaactaccgacaatgtcgtgtgagtatccatgggaaattgaaggaatcgttcgtgagatcgcttggtcaggcttaaaattgagatcaatcgtctgtgaactgtcatctggattgtgtctaccgatgtctgatctgaccagaacagtgccatgagcaaatcgttgtggaggatgcggcacaaacagagtggatggtatgcgatatgagaaatggatcattgcggctcttttgattgaggatctggttactttatcactgtctgtcgttgtctttctgtcaatgtagctatgactacagtatagcattgacacaatgagcagtcacacggagaagccttaatcagacactcgttggcaaatgcgattgtctatatgaccccgcttcgagttctgtagcctccaattcccgccgtcatcgcagtatgaatactatgttgtctgctatactatactcatggacaacggcaggactcttttaagacgtgataccgagactcatgacctggacaaagaaagggtacttattctgtgtcagctatttattaggtccgctctgaccttcggccctatgtaccgtactaatacagtaacacaatgggcaaccgcccttaccaaccccacactctcagtcctcccgttcgatttcgtccgccccgctgaaggcagtgtagtcgaagcacaattgacggaggctcttagctccaagaccgtggccgagctcgatcagattgccaagaacagcggtgtagcaggcgctactgatttctctgcagctctggctctctacgccattctcgtctaccgtctctcgggcgacgaggacgtgtgtctcggatccgacgacgccgagggaaacgtctttgtcttccgatccaacctcaacggcacttccacctctctgggtgacctcatcaagtctgtggttgagtttgaaacgtggcagaaggactctggcgtcaagttcgccgacattctggctgagatccagacctcgcagaagctggagtcagagccagtactgttccgaacgtctttccagcaccttcagagcgacacagagtcacaatctgttctgggccccgctgccggccgtctcacagacgtgtccgtctatctaggcaaggagtctctgtccatccactacaactctctgctgtacaaggaagatcgaatgaagctctttgctagccagattgtcgagctcattgcccaggctgccgttcttggcccctccgctgaggtcggtaagctatctcttctgtcgccccagcaacgggacggctctctgctgccccttcccacttctgatctcgactggagcgggttccgaggccctatccacgagatcttcgctgagaacgccaaaaaccaccccgaccggccctgctgtgttgagaccgcctcggctctgtgtcccgagtccaaggagcggtcgttcacctacaagcagattgacgaggcgtccaacgtgctggcgcaccatctggtggcttccggtatcaagcccggtcacgtggtcatgatctacgcctacagaggagtcgatcttgtggtctccgtcatgggtactctcaaggctggagccactttctccgttattgatcctgcctatcctcctgctcgacagaccatttacctgcgagtagctcagccccgagctctggttgtgattggtaaggctggcaagattgaccagctcgtcaccgactactgtgacaaggaactgcagttactgactttggtccctgagctggccctcactgacgacggtgctctggtcggaggagaagttgaagggagcgacatcctggcttcctctcaggctaagaagggcgagcagactggtgttcttgtcggccccgactctaaccccacactctccttcacctctggttccgagggtattcccaagggtgttcttggtcgacactactcgctgacctactacttcccctggatggctgagacctttggtctctccgacaaggataagttcacaatgttgtctggtatcgcacacgatcccattcagcgagacattttcacccctctcttcttgggtgcccagctcatcatccccacttcggacgatattggtactcccggacgtctggctgagtggatggccacctacgagaccactgtgactcatctgactcctgccatgggtcagcttctcagtgctcaggcgactgcccagatcccctctcttcaccatgcgttctttgtcggcgacattctcaccaagcgagactgcactcgactgcagaagcttgcccagaacgtattcatcgtcaacatgtacggcaccaccgaaacccagcgatccgtttcatactttcaggtcgcttcctacgcctcggattcgtctttcttggctcaacagaaggacattatgcccgctggcaagggtatgaagaatgtgcaactgctcgttgtgaaccgacacgaccgaacccagacctgcggtgtcggagaggtcggagagatctacgtgcgagccgctggtctcgccgaaggctaccttctcaacgacgcgctcaacgccgagaaatttgtcaccaactggtttgtgactcccgagcactggatccaggaggacgagaaggtcaacaagggtgaggcctggagagagttctacaagggtccccgggatcggctgtacagaactggagatctcggccggtaccttcccgatggaaacgttgagtgttccggacgagccgatgaccaggtgaagattcgaggtttccgaatcgagcttggcgagatcgacactcatctgtctcgacaccccctggtgcgtgaaaacgtgactctggtgcgtcgagacaaggacgaggagcccgtcctgacttcgtacattgttgtccagaacactgacgccgtcaacgagtttttggatgctcaggaggacgaggaagagaccgaccaggttgttcagggtcttttcaagtacagaaagctcatcaagaacattaaagagttcctcaagaccaagctgccctcttacgccattcctactgttgttgtccccctcgctaagatgcctctgaaccccaacggaaaggtcgacaagcccgccctgcccttccctgatactgctcagctggctattgttgcccagaaggccgctgctgcctctggagatgccaacgctgctcccatcgagttcaccgagacccaggctgccattcgagacatttggctcgatgttttgccccagcagcccgccaccatttctcctgatgactctttcttcgatcttggtggccactccattctggctactcgtatgatctttgagctacgaaagaagctcatggtagagatcccccttggtctcattttcaagtctccctccattgccggctttgcccttgaggtcgacaagctcaagaagggaggcgaggttgagttccacggtgagaatgagagcgacgagcaggagcaggctgccgttgactactacaacgacgccaagactctaattgccgacgcgaagcttgttgcttcgtcttacccatctcattccggcaaactcgacgcatctgcgcctgtcaaggtcttcttgactggaggaaccggttttctgggctctttcctgctccgggacctgctcgagcgatcgcagaacatccatgtgtttgcccacgttcgagccaagaccgtggaggctggtttggaccgtctgcgaaactcttccgaggcctatggcatctggaaggatgagtgggcttctcgaatcacccccatcattggcgatctcgaaaaggccgactttggcctgtctaaggagcagttctcccaactcaccgatgaggttgatgtgatcattcacaacggagctctggtccactgggtgtacccttactccactctccgaggtccaaacgtgcttggatctatcaacgtcatgaacctcgctctgactggcaaggccaagatcttcaactttgtgtcctccacctctgccgtcgacaccgagcacttcaacaagctgtctgccgatctggtggaggagggcaaggctggcgttcccgagtccgacgatctcatgggttcttctgtgggtctcggcaacggctacggacagtccaagtgggtcgcagagcacgtgatccgagaggccggagcccggggactcaccggaaccatcattcgacctggttacgttgtcggagactccaagaccggagccaccaacacggacgatttcctggttcgaatgatcaagggatgcatccagctgggtgagattcccaacatccacaactcggtcaacatggtgcccgtcgatcacgtggctcgggttgttactgccgcctctttctggcccaagcagccttccggcgtggttgtcgcccatgtgacttcccagcctcgaacacggttcaacgaattcctgcagaccctccagaagtacggttacaaagtttctgtcgaggactacgtcacctggcgtctggctctggagaagtttgttgttgaggactcgcaggactctgccctgtatcctctgctacactttgtgctcgatgaccttccccagtctaccaaggcccccgagctggatgactccaatgctcgatctgctctctctcgagacgctgagtggaccggagtcgatttgtccgctggtaagggcgttgacgaggctcaaatgggtatctacctggcttacctggtggctgtcggcttcctggatgccccccagtccaaggttgagcttgctttgccgaaggtggagctgtctgagcagacccttgataagctgaagagtgtcggtggacgtggtggtaacaagtaagcagtgccgtagggagtgccttgaccataaggcgatgcgaagcattgccattttgttatttgttaccgtgtaatggtgattattgcttgtctgtgagcagactatttttgtatgatttaattaattatgatatatatgactaaatgtgaggtgtcgcaataattacagcatttttcgtttgagatggtttgtattgtagccagtgctcaaaaattgagcgtaaatttgatagcgtttgctgatgagcaagtggaagcatgggaatctcatccccagaactcgtaatagttacatacggcaatacaactatcagtgacatcacatacatgccagttgtcacgcaaggttctacaaactcatggggttccatttaaatatactctatatcaatacttatatcagacgggcaacccacttagacaccgtggccgggtcgggtgttgacgtcaatggggtcgaaggctcgctgaataggagacttgacagtctggcccttgtagtagttaatggtggcctcagctcgcttggcgacaccctcggcattgaactcaaaggcatcgtagacctgctggaagggagcagaagcaccgaatcggtccagaccaaactgctggtgagagtatcgagaccagccaaagtcggagtagacctcgacggaaagcatggggatgccatcggggaaaacagactttcggtactcgagagactgctgctcgaaggtgaaccagtcgggcagagagatgacaccggcagtgatacccttcttctccttgaggagcttggcggcagcaacacagatggcaacctcagaaccagtggacacaaggtagatgtcacccttgtcctcggagatgagctggtaaccacccttggaggccttctcgatggaagagccctcaagctgaggcaggttctgtcgggtcagagacaggacagagggagtgtggtagttggtgatggccttgtagtaagcagcggaggtctcgttaccgtcggcaggtcgccacacagagaggttgggggtggctcggagccaggcgacagtctcaatgggctgatgggtagggccatcctcacccagaccaatggagtcatgggtagcaacccagataacgtggtggccagacagggcagacagtcggacggcaccagcggcgtaggagacgaagttaaggaaagtacctccgtaggggatgatacctccgtaagcgttcataccgttcatgatagcgcccatgccgtgctctcgaacaccgtatcggatatatcggccggagtagtcaccaaggtgggtgacaggaggctggaaatcaacagcgtccttccatcgggtcaggtttgagccggtcagatcggcggaaccaccaacaagctcggggaggacctcgtggatcttggtgaggacaatctcggacagctttcgagaagcaacggcattgtcggcgggggtgtaggtaggcagagccttctcccatccctcgggcagctctcgcttgaatcgtcggatgatctcagagtgctccttgggatactccttaccgtacttggcgaagagctcgttccactccttctcggcgttggcgcctcggtcaatagtcttggcgtagagatcagtggtctccttggggacggcaaaggtctcctcggggttgaagccaaccttctccttgaactgcttgatatcatcaggcttgagaggagagccgtgaacaccgtgggtaccctgctgcagagagccgtaaccaatgatggtggtgagtcggatacaagtgggcttgtccttggacttcttggcctgctcgatggcagcagccatgccggccagatcgttgttaccgtccttgacccagatgacctcccatccgtaggcctcaagtcgctggctgacgtcctcggtgaaggccacgttggtgtcaccgtcaatggaaatgtggttatcatcgtagaaggtgatgaggttaccgagctgcagatgtccggcaagagacatagcctcggaggcaacaccctccatcatgcaaccatctccgaagatgcagtaagtgtagttgttgatgatgtcgtagccaggcttgttgtaggtggcgccaaggtgggcctgggcaatggcgaaaccaacagcgttggagacaccctgacccaggggaccggtggtgacctcgataccgggagtctcagcctcggggtggccgggagtcttggagttgagctgtcggaagttcttgagatcatcgatagtgatgtcgtagccaaacaggtgcaacagggagtagtgcagcatgcaggcgtgtccgttggagagaatgaatcggtctcggttgatccactcggggttggaggaggtgaagttcatgtagtagttccacagaacgtgggcaacaggagccagacccatgggggcaccggggtggccggagttagccttggccacagcatcaatctagagttagcgatattcaaaaatcgagacatatcatcacatgctatgactcagcccttggcgtcaaaaagcatgaattgcactgcagtgtgcagattcatgcaggacaaacaccagaccagtcaatgtaattggctgtggtgcacgtccaaatcaatggcacaattgcccgtgatgcatgctccttaggagacgctgtggggtttgtgcataggttacagcttccgggtcatgatcaacttccgcgcaacaattgtgtgctaaatcagggcagaagcaattgctcaattgatcacgggtagccaccgcaacattcgcactccttctcagttttcatactcacagccaaggttcggatggtgttgatggcagtctcgtcagtctttgaaaattggggagccattttgaaagttgtccgtctagcaagctaccagcagggtatatatagcggcagacccaaagttttcctagctcttccattcggttcatccatactttgtttcccagggtaactttcccaatccagtaactttgaggcttatacgactcaagcttttcgcaacctcagaccagagagagctacaacaaggagggtggtgacattttggaaggcgtgggaggtggtatcggggcggggagtgattgtagcgtgctcaattgggttgttaagggcttttagtcagccatataactgccttctaccatctattcgccctcttcagctattgctggatactaaggttgctgatgccttatcgtgtcagtcagcgacatcggacaacttccaccatatatgaaactacggacggatacacagtcagcgggtagtcatattcggaggggtcttcggagttcccaattggggttccgttggaagtcatctttgtgtggccaccgttttttcccgtcggaacaccatcttgaaaactccgccacttacacccgtcctacccactctccctcgcactactgtagctacgtacttttcctacttctcagacaccgtattccctcactcacccaccttgcacctgtcccgtcccctgacgtcagcaaagttagcccagggccagaagatcgctggtatgcacgcataataggagctggtgtcgctaattggagggcgacaacgtgcccagacccgcttgcaaagacttcaatcggacccaacctgtcaacccaacctctcaactgacatgactagtcagggctgactgcactcaacgtcccaacactaattttgatggtctagaccgtgattagtcatctgtcatcgtccgttgggagagtgcataaagacagattaaacatgccacgtcatttaagaaggttattaagagagggtgaagacatttgaaaggtgtgttcccttccgttttccaatggcacagctaaaagcagctctttcttgcggttcaaacgacatcaattatacttccttgtctcatcacccaccgttttttccacctaggttgctggcataaatgaacgccccatgccagccaatgcaagattgttccgaacacgagtttatccgatcatgacgtcatccgccggtatcatgttcggtgatatcatcgaggtaccaatttgcaaacgtgcagtcagataacagcatgcaagccgattacgccggtgtgtagcggatttgatcactcagcttttttcccggaagtggataaacttctcttgaacggtaaaaaaaacatactgtgccaagtggggggtctgaaactcgactgcccaaccttttccgtcctgacaattatagcttgtaaagatctctttctccgaagactgcgggctaatcatatccctctctttccgtgtgcatttacatagcaactgtgcaaaccctttaggttctcgggcccaacgtatgaaccgtatcataggaagagaggaggtgtaataggaggcaaccgtctttggaagttctatgccgagttttataaaacgtgtgcaagtacagtgcaagtacttgtaggttgtgtttcaagttttcagctgttggctgtgttggtgggccagcgtgtgtttcaatagtcatctatagtatcttcgtgtacagaggagcatctactggtagctacaagtacggtatgtaccagtagaaccacgtgtgatacacttgaacaacaaaccatgcagggtctggctgcattgttgattccggtccgttctatacgctgtttgttctttagagtgtctccgtagtccgtctttgtaccttggcctgttgatctggcttctactggtctgttttttcatcgactttcatcgactatgatagaaaactgttcgttcatggcaaatgatttatagatatccacttgaacagaattgacagtgtttctacactgcggcatggtcgtttgatgatagacagcagaggactcgaagaacccatctagtagtagaaaagtcgaacagtatcacttacacacacacacacacacacacacacacacacacacacacacacacacacacacacacacaatcaaaggcagtaatgacgtctattcttcatgataccgttttacttcttcgtaatccacttgtccccgttacctccaccttctgtgtacgagtagtatcgttatcgcacattgtaataatgtaccgctgtttgtagatcttgctgcacctccacctgataagatcttcgctatcaccgtccaaccatagtaactgttcctaaccagtaggggcctggtgtgtccatatgtcatatatttgcagcagtggtgcaatgtactctcatattcacattcattcatgctatacccatacacactaatgcatatgctcattcttttcggtaaacgtccatcctccaaactgcttctgcacgctttcactgagatagtcgttggccacagaatcgctgggcacctcgctggtgaactctcggtcaaaattgctcgtgtcagtcgcagaccgcacgctgggcttgaagggagcagtatacttcttggccataagccgtttccagtcaatctcgttgaaaaacggatgggctttgatctcggcggctccgttgactcccagccgcttcttgggatctctattgagcagaccagtaagaatgcttcgtgcctctcggtccatgtcgtcggggaaccgcaaaggatcgttcaggattcgctggtacatttcattggtgttttccgagtagaaaggaggcagtccagtgagcatctcatagagaagaacacccagagtccaccagtcgactgtcttggtgtatccgtggcccagcagaatttcaggactcagatactcgggagtaccgcagaaagtgttagtcttctcctggccctccatattgagcttacaaagaccgaaatcacacaacgcgatgtggccgacgtaatccagtagaatgttttcgggcttgagatctcggtaaatgacattgtactcatgcagacactccaacgcacacaacagttcggcagtgtagaaccggcttctgttcagatcaaacaccttttcgttttgcaggtggtggaacagttctcctccgttgacaaaagccagtacaaggtagagcttgtcggggttttgaaacgagaacttgagcggcacaatgaacgggttatcaatctgggccagtaccgttcgctccgcgagcgtatgtgtgacttcggaccgcgacacgattcgcgcttttctaatcgtctttatcgcgtaaatctgttgcgtgtccttcttgcgcacctgcatcaccttgccaaacgagcccttaccgatcaccttgagcagctcaaagtccttcatggacaggggctcgttacgtgtaggcttgtaatccagcttgaggtggatttttcctgtaccagacgacagagcctgatatccgtcgaacgaagacgcgggggtgaagttgggggtcagtttcaccgagccaaggaagatatcaatgtacttaggcgtggcagacgatctcttggaggacgagtttacgctgctcatgctgccgttgcccccaatactgctactgagtcccagtccctccatctcactgggcttgaccagtccggcgctcagcttggcgtacaggttgatgctcaggggctccggacgcgacacgtcgaacgacgactgggccttccagatggggttctccagcgttcctcctgtggcctccagcaccagctgcgtcttgtcaaactccaacaccaggtacactgggggaggagtcattcgtcgggcagaagacattgtgttggaatccttaaccagctgtttttcaggtgcaaacaggctcgcatacttggcatagctgggaggcagcgacaagcccttggtttcgacaatgttgactgtcaacaggccgggcttgaaggagtgtgacaggtgaggggccggaggagcagcaggagtggcacacgaagtggaggtggcggaagaggcagtgtctcgtgagtctcgtgagtctcgtggggtgtaactgtgtgtggactctcgcgaccactctccgctgggtgccttgctgctggtggagcttgtgggggtcagcttctcatatccgccaggagcgttggtggacacggacggtaagctgagggtgtctcgtttggtgttagtgggcgactcctttatggtggccgtggagttagacgacggccttgaggagaaggctgacaggtggccttctttgatttctgtgttagtaagtctgctttgtaaggccccgataagaaatgctgttaacccctaaattgcgccgtgcgtgaagtactgccaagacacgcagccccggatcgtgggcaagagggatatgagaggggtgtggttgcgtgctcgttgtattatatcgcaacactgttgacgcagtgtgtgcagattctcgtgtgacttgacaacttgggtgtcattggctgtacaaatcaactccacaagttgaaacacaccacgacatcgccgtgagcaacggtaacggacgacagcctcggcaaacaactgagacagcagcgacaatagcagcagcacgaccagcgtcgttcctgcgacctttctgtccgttctcatctctcccaccacattttcttgtcacaaccaatatcaccacggccatgcccgtgtatccccacaccccctgatccagtcactgtggggagacaataccgggcccaaaatagccgccgagaacacgtcacgtctgccatgaccattccggccgcgtccgcaaacactcacttttccacgtagacattgtgggtcgtgtatggttgtctatcaggtgttgatgagctagtttagtccacgtttaactacaagtaacgtgttgcagagtcagctgcggaaccatgctgcagcaacaccgccgggaatactctcacacgcaacacaacgtgtcagctgccgcaggggggctgcatcaccccccaaaaaaagacatagcctccgccatgagtaatgcctcaccatgatttatgccaccggtataaatagcccggctgtcgcccatggttaatggagctgtccacgtgaaccccctgcgggataaacgcagtcacgtgatgtgccgcagagtctcttcccagcgcattacgtcatttccgggaaagtgcgctaccagtgctaccgaatgtcgccctatggagggcttgggtggctacttatctttctgtccactactcgtcgtgtggcggagacccatttatatatgataagagcgataaatggctacttgtagtcaaggaagctccgatattggcttggcaggcgggaaattacgtcgaattagctgcgatacagtttttacgatacaagtgtacagctacgaggagctactgttgaactgctccccactgcagattattattattaaccatgctgtctatcagagatcggcactgagatgaatgttcaggcgctctttcacgtgtatccagagtatacgagctgaatcactcttcagaaggtgttgaattgttgttgtacagtatgtacatacgtacttgtatcagtagtaactgtcttgtactcttaccgtaatcgtactgtatcgtattcagtagtggtgggttcttgtgcagaagtcactactcgtagtcgacttcaccattgttgtgtcgcatacaaattcacgttcccactccagctcagaggataatgacgcattccgctactggctggtggttgcaccggattggctccactcgtacctttgttctggcaccaaacacggctattttgggtcaactttgagcgtttcgagagctgtcattgccattgtcccgtcagtgtggcccacagtaaaaggtgtatttttagggcatgtttttatacatactaattcggcccaccatgtacaagtatacatcaaaacagaagagatggggatgacacggtcgaataataaaacgcggaaatgaatgtacaagtacaagtacaagtgcaaatttcccaacaaggccagttcttctgtgtatcaacacattatatcctgacaaccacccaatataccaccgctccgtctccgtttccctccacttgtacttgtacctccaacccaagattccactgcacccttgcatctggtcaaattcatgttacagtatgtaacgtgtaagaccactcctacaataatcctacaataattggctacttgtagctgatattattacggctgtaaaatgcaaataccctgtgcaaatacagtcaactaaccgctcgacacctcgactgtaccacgtggacaacattcaaagtgtatcactcaagccgtacaactgtgaatatatcccacaatggtctccatgacaaccattgtggacatcacgtgaccggcgacaaggttgcagatctccgtcttgctgcttgtgggtaagggtttcagcacaaaaatgacccttgactcgcgtgtcgcgtatcccaaaacggcttggaatgtgagccatcagattaggccatgatgaggctcttttcggtactgtagagttgagctaaagtgacggaaaagcaatatttgggccttgaataattcgccaacaaatgtcatgaaccgtccaattcgtccacggcccgaaaatccacatttttctctacatatttccctcaatccacatgtattgtttgttaggatgctcagccgcgcatcaactttgtttgtgcattcttcgcgtgtggaatgtggttgtgggggttgatggggtggtgatgaaatagagaaatatatatgaaaaaaaagagaaaaatgccgttcgaattatccgtgttttttcggatttttttgctctcagttgtaagccacaataccaccatttttcaacccacatcattccaaagaaactctacaatgggcaaactcttgcaaacaatgcaccatgcaggccgagtgtatcgttggtgctacaccttcgtggagatagattgttggtttctgacacagtcgttcctctaccaccgacacacaagcgacaatgcacaacccagcagctgttgcagcagcctcgcgggcataccccaccgaccccatggtgcaacaaatacagcaacagtatgaggcccagcagaactacaactacaacgctcaggcacaaaacacacagaacacacagaacacacagacacagacaccgggccagacaaccacagaccccacgacaaaacggttgtcccagacatcgacgtcgtccaacaagaagacaaaaacgcacattggtccttggcgactgggccgaacccttggacgaggctcctcgggacgtgtccgactagcacgacactcgcacaccggccagcttgcggccgtgaagattgtacccaaggcagtggtggccgacgccgtcaatgcggccaacggagaggagcatggcgccacggggctaccttacggtattgagcgggaggtgatcatcatgaaattgattgaacatgccaatgtgatggcactgtacgatgtgtgggagaacaagggagaattgtgagtattgaagaagcgtgaaaattacctattggtgtggagtgtatggtggtgaaatcacagggtgggtggtgatgttgtggaacaacgagactattttgacgcgttttgatggtgaggcgagcttttggtacactgagaggtgttttagagacatcaaagatgacaagtaaggtgttacagccgaagtatatctcctacagctctcagtcgtctctctaatttgactaaacgcgtctccacactgtcacatggctcagatagtcccagacgcagttcctggactggcacatgactttcaagtccgtctttcccttcaatcactcattgacatacccccctttaatagtcagatgaatgccccgaacggtacatttacagggcactgggcgtggttcacacaagcacggtacactgagcacatcaggacactaagagactcagcaattcgagaaagacgcatgcttgtggatctttgatttaactctgtaagcctccaactagttttggtgcttctatggcatatatcaatgttctcttcactcgcttgttgtgtttgtttaccgcttgccatttcgtggtttattattcgggacatacagccttatctttgcggagaccagtgtttgaagctgtatctcatttcctattttatttctgagtctccaaccaccaccaccaccaccacaccgctcccaggcagtgctacactgtacatgctgtatacgctgcatccctgtgtccatgcaggccaactatacacagcgtggatgtgcgcgacgtatactcaacatggaattgtcgcagcggtcgcttgaggcccgttaccaggacaacggccaaccattatacccatactaacccagatatctcgttttggaatacattgagggcggcgagctgtttgattacctcatcaaaaagggccgcctggaggaatatgaggccgcctcgtactttttgcaaatcatcaatggagtcgactactgccacagattcaacatttgccaccgagatctcaagcccgagaacctgctgctagacaagaaccgcaacatcaagattgccgactttggaatggccgctctggagacagaccggatgctggaaaccagttgtggatcgcctcactacgcctctcccgaaattgtcgccggtaagacatatcacggagccccctcggatatctggtcgtgcggtatcattcttttcgcgcttctgaccggtcatctgccttttgacgatgacaacattcgaagattgctgctcaaggtgcagaccggcaagttcaatatgccgtcagagctgagtccatacgccaaggatctcatttggcgaatgctacgaacagatcctaccactcgaatcaccatggacgagatcttccagcatcccttcgtgcgcaagtacagcggaggtgtgacacccactcacatccatgctccttcttacgagcatgtggcccgtcctgtggcttcggtgcaggacattgatatagagattctcaagaacctacagattctgtggcacggcgaagacgccgagatcatcatgcagaagctgctgtctcccgatgctaacccggagaagaccttttactgtctgctgatgaagtaccgacatgatcatgctgccgctgtggctgccactgctcctcccacgttgcaacagcaacagagccaggagatgcagcctgccatgcacaagtcccatagccactcgtctcgcaagcaacacaagcgcaagacaagccacaacagccatcgacttggctctcggggttcgctggtgtctgtttcttcggcccacaagcgaggtgtttctttcacccatgtcaagaagcgatctcagcagagcatccgaagcatgcgaggaagtgccagcaactccgtcgtcgcttctcctagaaaacagactgcctccgcacctgtttcggctggtactgcacccattcctttcaacgtcaacgttccttacacagaggcacctgctactgcacccgcagctcctacaaccgcagccgctacatccacagccactagagcaccagcacagccactggcaccaacacaagcggttcagtcaccaccacgacaatcacagcctgtccatcaacagccgccaacatcacgacgggctcccatctcgtcagctccctcgtggcttacacggtcgcctcctgccagcaaggatgccgactttgaagccttccttgactctgccttcaacaagcccgtcaagacgaagaagagctacggcagtctgcttggttctcccgttgacgctcgacgccatgtgactgaccctgctaacacgtccatcgcctctcgaaccgcagctggcgcaaccgctgcgaacacatccaagcgagcagtaaccatggcatacaacgatgagtttgagttcgaacggcccatgtcattgtttgatcctcgagaggtaggaggagacactggccgtgcccagcagcccagcgtatctcgcgctcaaaccatttctcacactcacacccactcgcgagagcgtgtggccaacgctcattctgatacccccaactacctgcccatgattttcgaggagggcgaccggttcgcagatgccatcgaggaggagttccatctcaacatttccgacaacactctttctgccccctccacgaaccacacaactcctatgcttgggggcgatcgaaagtcgagtgagtgggagaacctgtttgatttcactgagcgaggggaccaggttgttgtgggcgaggactctctgctggacatttctttccaccgagacaatgccaatgaggccactcctgtggctcctgctgctacccatgttggtcgggagtccacagagctttacaaggatcttcaattccccgaaatccctgttgtggaccgagatgagactgccgtggagtctatgcctcgaacccagtccaagatgaagatctcgggccagatgcagacagacaacttcatgaagcgaccttcgtccatcaacctcaacggtcatctcagccagagcaacctatcgcgacagacgacttctgcttcccagcgacgtcctctcgtgtctcgtgatatgaatacccatgctgcttcccctcgagaggccgccaagcctgttagacagttgcaggcagctgctgaactgcacgaacgacgacctgttgaggttctacagaaacagcaaccgcaacagcagcagcagcatcatcatcagcagcagcagcagactcagcatcagttgcagcccgcacctgtcttccgagagaagcctgtggtgtctgctccacgacggcctgcacctgctccccccgtgcagagtgtggccgacaccatggttcttcctatgcaccagcagcagcagaacaactcgcagtttaccattcctgctcctgtgcagactcagccaccccagtcaaagtccagccgaacgaagtcattcatccgacggtttggatttgcacccaagcgtgaggctccagttgctcccacttctaaggtgaccatgatccaatctagcgactatggtgctgctcctggtgtgaatgccaacgcccacatgaatgcacagaaagatccagctgcacctgcagctcatgcagcagctcatgcagctcacacgtccggtactgctcctgctactggcgacccttggaacgtcactcaatcgtggttcatgaagatgttctcgcgacccaacgtcgccccccggcaacctcctcaaaccctctactccactctcaccagccagcagctggaagacgagattgtggctctgcttgcatcgtggcgcaagtatggtatttccaatctgtctgtgtcacactcttccattaagtgtcagatcagctcgcgaaatgctctgaaaatcaaatcggcaaaattgcatatcgacattggtcccctcaaacacaccaatagttttgctcactttttccacgatcgaggctcgcagggctcgtttactcagctctatgaccagatcaaggcgcaccttgtttctcaaggtctgctcattaataactaaacgtaactaatatagctaattaattttatttaatgaatgataatataataatataatgatgacgtgtatgtgtacggtacattgtacttgtaggagtagcagtactgacctcttcttgactggcatagcacaaatctgctccttgttgatagaacggcacatgagaaagaagcatacagtgtgtactacaaattgtatttgtcattaagtacgatatatataagaaatgacggcatattcaggaatgattctataaaacaaatatgctctgtgatgctggtttgttcatgccgccttccgtgttggatacaatcaaactaccatgcacggtaatgtcttgaaagactgccccatgtccgtaatagccaatactgtagcatgattcgagtgtaacagcaggggaagagttaacacaaggactttgaaggctcacttctgagatatccagtccacgagcatggaaggactgttctgcgtagaccctcggtagccgacatatactgtaagcatctgcgccttgttgtgcttgccagtccatggcctgtctcaaagcttggtcgaaaagtcactgatgctggcactcaggtcactccgctaattttgtgtcggtgtccttctttcattactcctcctcaacaccgtactgcacagtgatccacaaactgcaggttccacattgcacgacaatctcgtgaaactggacatcgacaccctcgtagtacttttcgttattctccaaatgttcttcggtcaaaacgtagcctcctgcctctccacatcgacatggcttgtaccatgaaaacatgccatctgcgtcttccctctcctccaattctgtcaaatcaaacacgtcactaccagggccgcttttaacgccatttgcgccattcttcagactcaaatcatactccttttttagcttggagttgctcaaacatgcgtaggctgtcgtgatggctgtgatctgaacagatccagtatatgcctctctctcctggagcttgtcggggtggtttttcagcaatgcctgtttgtatgcagttttgagatccgctgaagtcagctcaggcacgtgaggaggctcagatagtcccaatatagtgtagtggttcatggtgaataatttgatgtgtggagaaaaaaaaatttgagttcagaggagtcaacgaagtgcagctgtggtgtatgtctactaacctccatgcaaaagtgagcatctgagcatccaagtattggtcaattccttacttatacttactactgtactcctactgtacaatacatatcatttgattaactgtccattcgaaatgacccatcgcactatgagtgcttgtagtgcagtagaagcagttgttgtgtctacgatgctaactaccaagtaacatacactaaacgtctgctagttcatacgacataaataaaacagttcattagtaacaatatatccttcaatccatctactcatcctcaagagagcaaatttcctcatcctcgtcctttcggaacaggaagggtctaatgacagactcgtaataaggaggtcgagggtcttggggagggttctgagtgttgaccaccttgaagtagttcttgtagacatctccgtcagctcgtccaatggcagagttgaggaaaaaatcaggcacgttgaaggcatcggtgtagccaatgacgtcctttcgcacctccaagagctgctttcggatctcggcactgatgtacttgagctcctggggagtgatgtagccctctcggaggaagattccagcctcctcttcgacggaccagaaggcgtacaggttggcaagtctggtaagaggctccttggtgaactcggtgccctcctcggcaattcgctcgtagaagttcttgaccatgtacagacgggtgtggattcgagtacacaggaatcgttgctgggacagctcctcgtaggcctgggcagtagacagacccttcttggccagcacctcaaactcatcggtggttcggttgatcagagctcgggaaacagtctcccaggccccaatcatgaccttggggtcgtacaagtttcgaccagcgagcttgggggaaccagcgggagcagccaggtaggcggtaggacctccaatgggcttgccagcccggacagctcggttagactggaccagagctctgccagctgacagacacagaatgttattgtctccctcccaggtgcactggatcacccaatcggagtaagcacgtccaaaaccgttgtaagcagagtatccgtggcctccacacgcctgtctgcactggtcaatggtgtgtgcgcaagcccaagttgtggtagccttgacaccagcagaaacagagaagagctccttagcctcggcaatggccttgggcacggcctcttggtcagaaacatcgaggtttaggagcatgtcggtgaccttgacgaactgatctctgaccttatcggcggtgcacttgatggcatatgtctgggccatgagggggagcagacgtcgctggtggtaagggtagtcgatcagcttggtctcctgacctcctccggcagcaaaagctcgtcgaatggtggcatatcgaagagcaatggtaaggaactttcgcgaggtgaaataactgtccatggccattccgactcggccagccagaagagctccgtaggccatctgagccatcatgggctcggtaacatttccgtcgctgtccacgtgacagtatcgcatgagcatgttctgtcggggaattcgcacatgggtgaactggatccagccgttgtcggttccctgacgtcccatcttcttgccgcagtctccgatagcaataccaggcatcaggttgtgagtctccacgtctcgcagctgcaccacaaacgtcttgacaccgtggtcctctccgtcgacaatgagacgtgcaaacacagctgtgtgagtggcggtatcggcggctcctccgatccaccatttagtggcagcaacgttgggagtgttgatcacgaactcgtctgcgttcttgtccagggtggcggtggtctccagacccaccaagttactgccgtggcccagctcggtcatggagaaggatccatagaacttcttaaccgacagagatcctttcttgacccagaattcgtactgctcaggcgttcctgcacctcgaatggcaccgccccagactccgtggtggatggcgtaccgggcaaaggctcccatatcgatttggcccagaagcatgcatcggtacagatacgtctcctcgtcgtcggtgtgcacatactcgatgagcttggcgattcgcttgaaggccagctctcgcgactgggccacatcggtaatatcgtagtcgccctcgtttcgaaacacagggtctcgctcgtactcttgcatcagtcggtccataagcagagtgttcttttcgcctccgtccagaaagtacgtcagcagacgcgggttgaaggaagtctggtttcgctcccgggccatttcgaccgggggctcggtaaacgtgttgagggactgttgagagagcatgttttggtacacgagatagaagggggttttagggtggacagtagctaaggtatatatgtagagataaagttcgagggtcggataaacgaataatatacttttgcggggtggtagtggaggagaagggtggctgtggaatggggtttaaagatgtgttggaaattggggactgttaattcacttgaaataggacctttatcttcttgagatgctaaaaaaatctatatctcttgctgaatcgcagaataattgccctcctcatattcccccaagactaccccacactatttgaaccttgttctttctcacgttcacgtatcaataatcatggcaactgagagtttagaggggcagttggaaccaaggagtaccgtaacggtatatggcggaaaggagtggaaaggacgagatagactgaaattattcccgagttggtcttatctttgaacatgtttgttttttttttgcagtggaaatatcgccccagtagctgtactttctgtacattttgagcggtgcatcttggtatgcatagtcggaggtaacagagtccaagcagccgactttcatcgcgtacgtggatacactacaaccagtcagggtcataagcaataaactctttacattctgggaatttcgtcgagggttgtaaaatgccggctcatagtaatcatcgtacatactggtaccggtacaaggatgtacagcgcctgtagtgccgcttctctatgagaacaagcatatattgtaagaagcgtgtactcgtagtaaagtaggcggtgaacgcgagagatctactattggccataatgcacaaaaatatatggatttaatgaccgtctctctccactcaatctcccttcactgtctttcacaatctcgctcgacgtcaacggctaccccacactggcgaaactttgattcgcactactaatcaattcagactagccgagctacagtaggagagacatgtcacacagtgacatttggttgcacgtgcgcgaggataagacgaagagttaatactttggaatgtttctgatcagacagtcagtggagagataacccagaatacacggtgatatgcaccttagtgatccttcgagaacgcatcaataagacgagtaacaccaaaacagccaagtgcaatgtatccaagagacaagccccactatgactgaaattaagaagttgagtgagaaattccctggtccgacgcgttgtagtgtatatagatagttgcacggatctcaccgtcttgtggatcaaattatggtatcctctgtgagagatctgttgtgtatatgagttgcactaagatactatcgtacgaggtctccataaaagctggtattgaatggttacgatatatcttagtaacgtagctaccttagtatttcaatgagacaccctccacttttaacacttataaaaacagtagtttggcatataaagacatacttcacgctttgtttaaatcacaatacgcatatactaatctacaagtaggtggtatttgtctcgactgtatccgagttgctacacattcctatatactaatcatgcagtattaattgacaaaaactatcagttttcagatattgtctatacattgtgttaatctgcctcaattgctatctcaaaccactgttcataaacgaatagatatagcaatagacgaggcacttggatccccatgatcttagagcttggccccaccagactcagctaccttcttgagctccatgttcattcgagcgtagtcatggaccttgtcatcgtaaaaagtggtccattcaagaccataagcagccactcccgagtaatcttcatagttcttgaaaatgcacttttggtcgttgacgacctcaatttccatggtgtgaattcccttcatgacaacattggagtaaaagtggccttcccactgcagctttgacttgtcagcgtgaagaacatggacctcaattggagcgtgcttcttgccattgtatctggtgtaaacaacctccatatcatggccaacaagacgctcgggattggcagaatagtcgttcagctcactctcgatctccttgatgaatgtgttccacttgggatagttctggaactggtagaggatctttgagatggtgtctgccgatgcgttgattgacagttcggtgtaaactcgagtcatcgtaaattggagaactgaagtatctgttggtgtgtatttgaagaagaaatggcgtgtctcaattcaaggtcctatttatacgattgcggctttcaaacgaaaaagtgggctacagctaatagtaagtaatgttaagtaaagatcatactaggatatctttacaaagccacaactattttatcaaatgatattaaaaaataattatactggtaagtgatataacataaacaggctgaattgtatcaatcctgagaaattcgtaacctcactctataatggcacacgatcgaaatatcacttagttggtcttaactaattccaactttaatctgaaccttcctacaaaccctgttaagcgaggaatatggggtgactaaaaaagtaacgagcaagagggaaagctggtagataacatcgttcgagaggctcccggaccacttttttgcgtgcattaaagcgattatcagtgattttcacgcccaaaacagccaataaatggacggttatgccatacttaatccctcgtatgtggtaatcatgtgatcttggaggacagtatgtaacagatactactggtactacaaaaacaagaggaaaaatgaatacgttagataacgtgactgataaaaaaatcgatatatttctttaatttccaaaaatcctcttcatctccaaaactcctctcgaacatcacgggcgataaagttccctcgaatgcacatcagatgccttgattaaatctcaggcagcagggatcatgtgagcttctagaagatgggagagttgtccaatgtagagcttgaaacctgaagtcgacataatcgaatcacgtggatgattacacgccactctgaatccgaccacgtgactaagttctcaaaatatagacaatataatcaaaaccacaggaggggaagtatgtaccgtacgtatgtacttatagacgacagtctctagactagtcgatttgccagatcataagttaagagtgaattatcgacagtacagcagttctactttctttagccggagttctacggtactcataacaggatacaatacaagcctacagttgatttgtattgaggtggtccttgcagaggggtataatatatcaagttattatatataaaaaaaaggaaaggggacagcttagataaccacagtagccagcatagcagcaggcgactcatactacaagtacttggaagacaaaaaaagaatagataatattaatttaatgggttaatgcaatagctcactcctcaggggcacttgtttccatgcgcagtaggttcatctgaatagacagtgcagtaggcaccgtctgggcccgttgctgattggtgcttgtacttcaatccagcccagctcctcggctacgcctcagtcacctcagtcgtcgcctccttgctcttgatcctgctccacatacctccaaagccccagccagagctctctttcttggcgactctcggggtgttcgagctattgacctgactcagcagcagtctggagtcgaagtttctcaatccagaatctggagtggcggtagtgaacgttgcagctgcagaagtagacgccaaggttgttcgctggaactgtccaaagtgggcgtcgtggccctggatgaattcggtctctggtccgcattcagccccctcggccatggaaaagatgctttcgaacgacgtggatcgcacgagtttggcctgtgcgccgagctcagtggacagctcgggaatgcgcgaacacgaggaaggcagcttctcgtcgtagaggtcagagaagcggtttctgagagtcgtttcatgggacacaaaatggcgcagctccttctgcaagtgtgatgcatgccgggtgggcgactcatcaaagtccgagttggacgcgaacgagtcgtcgaaagtagctacgtcatcaatgactggggtaggaggtaacgatgagcttctagtgtgctttgactcgttggtggcatttgtagggtccctctttccaggcctactgggtgtgtacaacgtaggtgtggccttgagagactctggagtggggtagttgaaggtgtgcaggttatgggtgggcagattgtatgactgcaggttgttgatgctctttcgcggcgtgacgaatctgtccatattggagttgatctggaacacacggttggcgtgatcacgcggcgaaatgtccatgtcatactcgtcatcctcttctctgagcaattcacgagactgcttcttgagaaccacgtcgtgtttgtccagctgtttcttgagatctcggacctcagaacgggtagccaaaagctcgtctcgcagtacatctgtctcgctctttttgtggttcaatctgtactcgtcaacaagcgtgtttccggaatctacgctgtagcgtgtcttgtttgaacggagggatgccatagacttggaagccatggcgtcggcagcctgttgttccagctgctcgtagtcacgtgctagccgctccagcagcatgtctgtttttctccaccgtacctgagcggccttcttgtccgattccgacgtatgtagttcattctgcatcgactcgcgtacttgttccagcagctccagctggttctccagagactccgtctgtagcttaacacgggtcattttcgcctggtacttgcgcgactcctccagctcgtggttgagcgagtcgatctgtgagtccgacaccgctaacttggctgatagggtggcaatatcggcaatgaggcccttgttatgggccagcatggaatcattttccacatggagggtcgtcacctggccgttgaggcggtcaatctggtccttcatgacgctcacctgggctagtagtgcctgtccgacctcggccgacgttcgtagagtggcttcgagctgggaaatatgtttttgggcgtggcaaaagttggtgcaagtcgaagacccacagcagcacgaaattgaggttttttgtaaagcgagagtggggagggcagccgtcttgatgttcatgtagtccaagtctacgtcaatggcttgagacagtcagtagaacagatatagtctgtcctggtgtcgttcagtgtgtgatgtatgtacctgaatgaccagtctgtgtcgttatcagaaacaaaagtcgtagacgtgtcactatcagggtctgcgtgtgtctgaagagttgtcgtgtcgattcgtcgtttccgtctcggatgtgacctgtatctgtgtgatcaaatatgtcgtcgatactgtctgataatgaaatagatcccacttacttgaaatgcaatgtaacagcctcaaagacaggtttgatgcacggcgtaaaagttgtttcagcccccaaaaatgcgagtagttgcgataatcagccaaaaaaacacgagatagtcccccttgacacgccaaaatcccgttcaatttttttttacaaaagatccccaaaggtatataacccactaacaatagccaggcccgagaatgcaaaactcaaatagacttcagccgtagacactgagatgggatgtagactgggctactgagatgatggagagaaaaaaacagcactgttagatgcagcacaaatacaaaaatattttggttcttttataatccctatctgtttactttcacacaggatattatcccctacaagttctacattccaacccataaagtaaactcgcatgggaacaaagaaacgcaccaaacacacgcgaatactgcgccatataggtttgaaggaaaacaacatgcacggtgcggatcattcaagagtcgcggcgcaaaaaacccattaaaatatccatcccccctctgtgtattcatttcttgatagcttctggaggaggatattaattccgtttttaccccttgagccagcccagatattttatacaaccaaacttcaagtaccatgcactaaaaaacgtgttaccagaggtttaggttggggtaatgacgacggtattctaatgaatgagagactacttgtacaagtacggtagttaacgcaatttcaacagtgttccattgtggttgataccgtctcacactgtcgctgttttgactcaccagacagagtttttaatccagatcaaagtccatttgattgtccgaaaaactgtatctgaactcctgtgttgaaaccatatcatcttgcacgttctcagtagtgatatttcaactggataatctagatcaataaaggtctgattcttttagttgctatttcattggaaacccctcttcaagaggaagactccaagccagataattctcccccgctgtattgataatttctctacggccacccctaagaccaatcataagacttgcgtattgcaggggagtacatattttggcagggagtcgaaaaagaaaagcggcagccgcaacaagaaaaacgcgggagagacagagacgacatattctttttcaagaaaccgagcttacagccaaaacaaatgccgagaggaagagacaaaatacgaaatacgaatgaacgcaaacggctatggagacaccgttgtgaaccagttcacagattgatgagtcaatattacgggaacgggcgacgctcttggaagctcagagagggtctccttgtataacagtcagccgggagtggactacgcaggtcttttttagcgtgtttctcacagtttagcacgggcttaaaacacagagaacccttccgtcgatcacgcgacctattggaccttgacggacagtacagtaggtagtagagttagggttgcgctcggttgggggggggtaacaggagtctatcttgggggattgacagggtgggcatggcatggaattgagaatgaatgccatcacaagatttgtcttgtttttgggactaaaattgatgtgttgtttttaatattggaaagtttttcgggtcagaaggtggagcttcgttggaactatatcatgtttcttacggagatgtcggagcttgcggatcaccataagtgatttgcagtatatcgatgtttcacatgggttgaaaagtgttagctccagatttattggtggctggttgggcgagagagcggccgtaagagcacaacatctgccgtatttacactacgagtaccattctcagagttgaaggtatatcggagctgtaacctcatggtagagcgctgtgcatggacccttttcgagagagtgggtgatgtgataggagcagcagaagatccatatctaccaggtttcaaatactgtacttgtagtcttacgacacatccatagagatacacagcagccacatgcaagctgagtcccaatatccatcattgtccagattatagatatccacaagttcagtctaactacagctcgtcgcagtctacccctttcgttcaggtagccattgcacacaccactccagcagatcttacacccaagtggtggccaaaatcgtgccatcgtgcgcctgtaaagaatgtcgtttccaaacatctttcgatagtacaatagttattggtcgtgttatgtcttgttcaggggagaagtcttctgttgtcattagtattgcgccggaacgaagttctccagtcatttggggtcgttaaggcacccaaagcagtagatcgcaaaatttctgacggaataaagacttctgagcgcgctcatttactaaaaacatacttgaacattgagcctttacactactgtacagtaaagcgatgcattgtattcattgcttacaaccactggctcgaagaagtgacaggcggacgggatctagagtcaatgacatgacgcaagaagttataacctgcacagtagacgtctttatcaactaatccatgaactatatcaattcggcatgggtaagttattcaggttcttttgcagtacaggtatgtagcttcaagtcatcgtacaagtagcaacatgtcatatcgtgtcttcaggtatagctccagtagaaagaacaatgtatggagtaaacgtgtgttttatatgatttaatgtgataatatactgtgcgatacagtaaatagcagctgactacttttgcaggtctaaacgtcagcacttactccaacatcctgagtctcaccaacaatcggtttggatgttatggaatgtattgtttctcatactccgaaactgtctttggacaacactataaggaagcgagataggaatcaatctcaaaaattggcattgtacaccttctaccacatgctactcctcctccctccacacttacataagccgataagcttcctcgaataacctcttgacatgcatgaaatctaaaccacctccaacttttagtagctgtcaaaatgtcggaactactaaacaacacacccaagaagatgaatgaatcaataatcagcggtgtttcgtcagaccccagccggctggaattttctctgcagagccctgctctttgtctggcatggaacgaggattcgctggtctacggctacaaccagggagtgacagttttgacccgcaagcctgttgttttgggcaatgcttttgcatccgaatggtctttcctgtctgtcgagtaccatatgggtctggcatgcgagctgattgccacctgcggcgctttcgtggccgtgggacacgatgataacacaatctcccttatcaacacagccgaagaggacgcaattgagagaactgacgtgaaacgtggtcactacgactttgtgaacggcatcgacgtcaatttggatggaatggtggcatccgtgggtgatgaccgacaactgttgatttattcagacaagttggaagtggtgcacaaaatcaagctggacggagctggacgagctgttaagttccaagaggatggaggaccccatctggtggttctggagggttccaaccgactgaatgtctacgactgggaaaagggccagttcctatacaccgttttctccaacgatgtagtgggtggctcgaaaaagatcggatgttgtggtccgccagcagcagtcaaggctgttgctctgaatgtgggacaaaaccacgccgaccagttgactgttcttggaagcggatggtggcgaaagtactccagtgccaatttgcagggaggaggaggccatacggtgcccaacaagcagggtgagctgtatggcagtcggcagctgagtggcgctgtgttctgcgtcagtaacgacactgccgtggtggtgagcgacaagaagactttattttactcgctgggcacagagaaatccattgaggtggcttgtgacttcgtttctggcgtggaagctgcagccgtgcgagccaagggcgatttggtggctgtggcaggaggacgagcactggttctgttgaatagtgctgaaaacgagagcaacattgtgagacgttaatcacagaaccagtaaggggtttggatggaaggggaaacattggtgagactactttcagtcatacgttaatagccatgccatgtaatttaatcatagatttgaaattcactaaaagcacacataccgacagtgaaagatgcaagctgaagtgtaatcgattgatgtctagcatgccatatattaattgcttccctatataccgtcattataacctcgttctatccttatctatgtgcaattccttatgtttaccttttcgaatgtttaagcaggagaattaccctcagcccagtcaacaaaatacttgagcatctcctcggtcactcctcttcgagctcccttgagaacatgatcaaagtccttcttggtcacctccttggcatcttcgtcctgagacattgcgtacagaccagcctcttcacagagagcaacaatttcggcaccggtcatgccctcagttgtcttggcgatctcttctaggtccacctcggagcccaggcacatgttcttggttcggatcttgagaatctgctggcgggcatgctcgtcaggaggtccaacgtacagcaatctggacagacgaccaggacgcatgagagcagagtcaataacgtcaggtcggttagtagcagccagaaccatgactccgttgagagactcgataccgtccatttctgtaagcagagacgtgagcactcgttctcctccagcgcctgcctcagaatgtcctctagcagtactaagagcatcaatttcatcgaagaagatgatggaaggggcagcagcacgagcctttcggaaaatctcacgcacggcacgttcactctctccaacatatttgttgaagagctcggggcccttgacagacaggaagttgagaccagactcgttggccagggccttggcaatgagagtcttggaacatcccgggggtccgtacagaagaacacctctagggggtgtgattccgaggtttttcatagtatcagccttggtaagaggccactcgaccatctgcttgagcttctccttgactccagactggcctccaatgtcactccaggtggtggagggcttctcgaggaagatttctcgcatggcagatggtctgacatccagcagagctcgttcaaggtcaggcatggtgacttccagaccggagttgacagcgttcaaagcactgccatgctcctccagacctcggttgatggcgttcatgactccttctcgacacagagcgctcagatcggctccgacatagccgtgagtaatgctagaaatgtactggatgtcttcttcggacatattgtgaggcatatcagccatttggatgctcaaaatgctcagtcgggcctcagcgttgggaatgccaatttcgacttctctgtcaaaccggccagctcgtcgcagagcaggatcaatggcgttgggtcggttagtggagcccacaactacaatcttggcagaagcagactgagacataccgtccatcagagtgagtagagtagcgacaactcgagactcggcttgtccagactcgtctccgtctcgtcgaggtaccagagcatcaatctcgtcaatgaaaacaatagctggctggtactttcgagcctcttcgaagatggctcgtaaggacgactcggtctcgcccaggtatttggatacaatggatggcccgttgattgtgagtacgtgtgcatttgattcctgagcaacagcacgcagcagcatagtttttccggttccagggggtccatgaagaagcactcctcgaggtggcgagatgccaaacctcgaaaacagagagggatgatgcagaggaagctcgatggtagatttaagctccacaatgtgttgatccaggccgccgatggacttgtaagtagtagttttgggtagctcccagcagtttcgagttgacacaaccacttgtgtatcttctagcagaaacaagggagaccaatatgaaacgtggttcttgagctcagattgttccagtgataaggatccaagatctgtgtcgccaacgtctgtcactgtgacgttcacgtactcgccagactcgatcttcacctccatactgagtcctggagacaccatggccagcttcttgagatcggtagttgtagcatcaataacagcctgttcaggggaattgggtgtgtttatccgcacactgaccaaactcgccatgtccatcttggtcttatatctctccactttgactcgatctccaaacaggagagctcctgcgtccttgagtcctgcactcacggtaaccacgttgatgtcgacaagatcggggtcctccacagcctcggggatggcgcaaacggttcctcctactccccgatcaccctcacggtacacagacacaaactcgttgttattgagacccagagcctcgagaatctttggatgcaatccaaccttgtagatgttcttgttgtgcgtcacggcggcttgggtctctccctggggacgcacgataaacagatcggggatcttgacgggcttttctttcacctcgccatcgtccttggtcgaagacgactttttcttgctggtagacgagcttttgggcgccatggtgatgatgataagaaaattaaaaattgtgcatgaaattatgcaagctaaagggagcttattgatgaaggcggggtgggacagtgatagatatgggaagagatgaggttgaatagtagacatttttggtgtcaaataggaatatttttgagctcaaaaattgatcgaagctatctaaaatcgaatctgcttccaaatggacgagatagagcgtctgtatcgtgttacttatatattttgagagataaaagtttgagaacaaggtaatgtgatttaaaccactagttagttactaatataaaaacaatcgatctcttctgaaagaaactggatgagttacatactgttgttgtgaagacactctgtttgcacgtccagtcaataaatagaccgctatggagcttatttgggtatgcccttttgaatgatagcgacagtgagctaccttttgtatacaagtttttattgaatataaataactattgacaatttgtctatttacagtgcagccctttctgctgttgtggctattacccgtcacgtcgtgttccattcatgccgatcgttgttgtccccctacaagtaggtgtttcatacccagatccatcggttcaggctcggtctgggacatgtcctagtggccaactcaacaagaacccgtggatagatggagatttaccagcctgctcgttgccgtttgtttctatgagttttgacatcttcaacgcaatactgccttaaaccaaagtcattaaaccagaagtcatgtagccctccaaaatcacttcatgaacaaactcctcggccttcaccccaccatgctcaatatggatacttgcaattagcgcaaacagcatcttggtggcatagtgagtatcatgcattttcctaaacgcctgtctcttgttggcattttcttccggaagaggcacgtatagcgacttgatgagtttcgtgttcttgacaaacgcaagcaccagggtctcgtcacgagtaagtcggtcagccaggccgcttcgacaaatgtcaaagttcatcaggttggccttctttcgactccaactgggtacctttgtcaggtagctgaaaacagcaaatttgtatgcatgttggcccaaaagaacacgcgagttgatagctccgtatcccagtgtgtcttcaatgtgggtcttttgtgtctgaaacggcgtgccctttctttgagcgctaggtgtaagcgtatgtgaaatgcacagaagctctctgatcacagcctcaggaagctcgtatttgggtccgatgaaatcctgaacgtagcgtacagattcgatgtcgattgtgaccatcttgagttccagcaacgagtggacatcggagtagaggatttctttgattggcgacagaggcgaaagtcgagttcggtatgagggctgagtgtcggaggttagataatgactggatcgtgtccagcgggagaagctgtggtgtatgagtggatttgcgcgcgagatctgcggcctaagtccttttaatgactgcattgttgtggatggaagtctgggtgccacttgaatttggtgatacaaaataatttgagttgggaggttacagtaaacggtgaaggacgtccatacgtgatgggggtgtaattggggtggctataagtggctgtctacgaagagcgggagggtattctaagagatttgagtgactattaagggagtttgaatagagtgagttattttctatactcaaagtaagccgttattgtagtgtttgtgtgatgtgacatattctcccctctatccaagtccttttaaaaattccgtttgttgagatcaagtccagaacacccaactaactcctgcatacttcaagtacgaaataagggtctgggggtctcaaaatattctttcattctagcccaatattgaacatttttgagatttgaaaaaaaggaatatataaaataaacgagtagaactgagtatagcacctttaaaaccttctaccacgcttcaagacccacttcttcaatcccctaaacccccttctccaccaatagagtttgtaatttttccacacgtttttctcccaactcgcgagggttaggtttccaaccccaatgaggacttaatgaccagcctcccttaactccagcagcgaaattagcctcccagcctgcccagacgcgtttcctccctctcccaccttttttcttatacccactctttggtcaccacatagcatcagtcagccaagagggcatcttgctacgaaatgacccccgctacacctccacaccatcatatggacctcgacaccccccccacccctcgatatgggcccatggaagactcgccgatgcgcaagaaggacgcaaaaccagcgtcgcggccacacgaccccaaccggcaaaagacacagagacacacatcaatgaacaacacaaagacgcccaatcgacagcggaacacaaagggagaagcgcctgcctctgtctcacggatgatgcttaccccggcggatactcccgtgtcgagcaaacgaacccccgttgatgtgcttgaatcgaacaagaaaacaggtcgggtactattccccccggcaaacattgtccaggctggctctggacgagcgcgacatcacgcacacacacccgtgaccccacggacgtcgcgagtgcgaaaatcgactcacaagcatctcctcaagaccaaacccatttcgcagccacaattcaccattttctctgactcggcggctgccaaggcggaagccaatggagatgaccccttcgtgtgtcccgacgctccaaaagccgcttctccgcgagcagtttcgtcattggcacatcctcaccaagaaaagccggacccctcggtaccgggcatgtggtacaactttagaggcaagaaacactaccgaccgttcaaacagggcgagggtctggacgtgaagcccaaggtgctgttcaaggaggaattgagcaaggtgacgatccaggagactgacgatccgttcggagggggccccatcggggggcctaccattgcttcagagattgcagatgccgccgaaagcggagactcggaggccgaaacggacgaggatgccgaccctctttcgtccttctccgaggagattgcaagcttgagctagcgtcgtcatcatacatgacattatttattgggtgagatttttggggaggattacaagaaataccggtatagcatggttagttaatatatgataatgggatagacaagaatagagagagtaggaatgaacttgaacatgcaattataaaccatagtcatggtggttgttagtacctgatggtgtgatatgagattcaagtctgacagctcagctacttgcggcataaaagcttgatgtcgattagtcatctttgtgagtgcaagtgtgtagcgttcgttgtatcagcacatggtcacatgactacttgtacttttagaacaccggaaccgccttaaatatgtgtcagcctgccaacatcaccatctacggtgcttcttgtacattgcatggatgcaggcaccaaggcatcgagcaggccccgagccgcggtaggtttcggttagtggtttccacggtaacgatagtttccggggtaaccaaggtgatgggtaattggctggagttgagaaaagagaggacatagaacccacgaaggagttaggtgatcatttgaagaggtctttgggagtgtaactttggtcagcatgtggaacgggctagctacagcgttgagctatgttatgtatgcctgtgtggaagtacggcacaagggaggttgagtgtgagtaacatattagataaacgtctagacacgaccatgaatggcaaatgagatggcacaatggttgtattagagccgagactagtctatcataacctattcgatcaatgtatcatggtggttcgggagtggaatagaaagtacagtaagagtgcgtctgagggaagtaaagtaataggagagatgagttatgatacagcgaacttatgaatttgaattacgaagaagatcgatattgttgttttcgttagagaacggcaaatcatggggtttctgagttctctattggtgatagggactggggacagtgcagaagcaagtgtcactctcaagagcctgattcctccaatcacttatcgcactacaagtactgtagactcagatactgtaactcatgaagagagtgatatggactcgaaaacaaaagtacggtacgtacttgtacatgtcctttctcatatagccccatatctaacccaccccatcttagagcccccgagctccctgttcccgttggtgtaccagaggaacaaaaataacatgattagtattaatggctctctcagcaatagttcgtcaactatagacgattcgatgacgtcacggccgcccctatcacagttctctaagcccgtactgtactcttaacctgactcagccttgatacagcaacgcgtctgcgacgtgacatgatctgcggagtatgaattcgggtaaactacaaaaggcgcgatctcagatggaagatattcgtgcctaggattccggaagagtaacatgactttcggcatgctagtgctaagtcttccattttttgcactatttttcttccacgaccccccactctgattccaccacgcaaaaatcagaccctgcagccaagagtgggccgtccatctatagggagtgaacaagaccagacccgcccaaaaaagtgtaaaaaaggggttacacagcgtagattagggacagtcaaacaacaatcgaatagagcacgacacataagccatttattctccaatatatacctatacaagcccctctcataccgttccatggcctcactccacctcatgacacaactataactcaactgactatataccgttgctaaccttgagtgcagatcgactattgtctcttgatacacgtcaccgagcgagtacaacaacagcttgaggagacgcagccaacagggatactcaacttagccacagacacagcgcacaagaccgccccataaacacctcgcctgcgtaacgttacacaaacacataacctcacatcaccacacacactcgttcaccatggacgaactaccgtcacacgagccaaaaaaccgctacagtcgaagctcgagcattggatcacccgcggacgcgagatatgctcccccatcgccgctccatgagccgtcagacgcctcgcaaatcgccattgccatggggggcgtgcgccagagatcggcctcgattcgaaaacacagacgccagcagccatcgcaggtgttcattccgccgatgcacgagaacgtcacggcgccacgtgatgagcatgagcccaaaatgtcgtcacccgtgcccgaaacagacgaaaaaccgctgctccaaacttcggctgcaggagccactctcctgatcggtatccagatcctgtcgaaactggcctcgtttggtcttaatcaaatgctgctgctggtagccaccccagccctgtttggagccaacgcacagctcgagtttgtgctcaacacagtgctcttcttctcacgagaagcagtccgactcgctctccaacggctcaccctcgctggaaagaagccagatgtgtacgtgtttggcgggggcgtcgtacaggacaccgtatcaggcacttcccaggccgtcatcaacatgggctacatctctgtactcctcggagtgtttttctcctccgtggccgctgcctcccactcgctgttttcggtggcgtacgcatcatgggcggtgcagctcgtctgcatagcagccatggtcgacttggcatccgagccctactacgttctagctatgcaacagctcagattccgaagtagagccgcggcagaggcagtcgccattctcgtgcgatgtgttgtcacattctccttcactctgctggccaaagacaccgatggaggcctcaacggtggtgtgctcgcgtttgcattcggccaactggcctattcgctcatctcctctgccgtgtacatctacaccgttcggcaggacaaccgagatcgacagttttcgttccgacctcagaagatccagccgttcgagagtcagatggagatgtctgacaacaaccgggatgtcatcacacataacgcgtctccttattatctagacaagcccactgttcgactcgcaggatccatctggattcagaccgtattcaagcactgcctcaccgagggcgaccgaattctcgtgtcgtacttcctgcctctctacgatcagggagtttatgctatcgttctcaactacggctctctggttgctcgaatcgtgtttttccccatcgaggagggtcttagaacattcttttccaatctgctaggcgaaaagccctccgagaccgctctcaagctgtccagacaggtgctttgttctgtagtgagaatctacacctacgtggctctctttgctgcaggttttggtcctaccactctacccttcatcttcggtaccctgcttggagctagaggtggccagtggtccgaaggagctccgtctcggtctgctcctgccgtcatgggtgccttcgcactgtacattccctttatggctctcaatggagctctggagagtttcgtgcagtctgtagctacgcctgctgatcttcgacgacaggctgttgccctaggtgtcttcagcgtggtatttgccaccgttggtggtcttctgatgaaaactatggatctgggagctcgaggacttgtttttgccaacattgtcaacatgactcttcgaattggctggtcagtggtgttcatctaccactactatgttagccacaaggccgagaatgtgaatcctacccacctgttgcccggaaagctagtgattgctaccggagtaaccaccattttggcctcgctgtttggcgtggggcgtgtctcttctttccgagacgttggcatcaacattggtctggctctggcgctagctgcggctattgccgtggaggagcgacaagctttggtccagttggtgcagcttgttcgaaagaaggaggataaagtcaaggtggacgacaaggaggagaaggagaaggagagcgacaagtccgagggcgagtcggagtaaataaaccaaaccgtagaatctaaaatgtatatctgttctgatgtgatacaaaagtagggtgaaaatagttacttgtacagtatctatggttgaagtacaagtacgtacaagtacaagacctgagctcattaaacatgtataactttcgtattagaagatgacattaactgatgatacaataaataaatacttgaagaatgcaaactcggggttacaagctaaaatgtggtaacccatccttgagtcatgtcagactactgacagcctttgcgtgctacccgctcgctactcgactaatctcctacaagtaggacatcggttcgagtactcactccaacaagcaatacatccaaaatgaacaatgtgaccacatgtcagcaccttgggaatgttcttgtctggagcctggactccactgagtcctccggccttcatgctgtctctacagacgacacagatgtcgttagattcgttgatctgcttttctgaagcgtcctgaaggttccaatagaggccgtggaagtttggagtctttcgggactttatgagttctcgagttcctgaaattgtgatacgcaaagtcttgtagaactcgcggaaaatgtgcaggggaatgcaatagtcgcccatgagagtggctgagaagatgagataggagatgagtttagctgtagtgacagcaaatcctagcagaaagagccagtatcttttactcttgaccaactggcccttagagagacacatgtagagcagggccttttctacgagatcaaacaacattattcctgtcgatccgagcagcgaacaaaagaggattgtgatctcaaacaagaagacagaaaccaccatagattgagagacgcgcagtttacgcaagcagtatctgatccacagaatgtcggtcacgtgcagaatgaccagcgccagaatcagccgtgggtatcgcatcacaatgccactgttggggtactccagatatacatagcgggttcgcactgtgcacatccaatggagtcccttgatgaacagcagggtagcaaacatgccgacaaaccgcctgttcagttgtgctcggaacacaaacagctgcattgcaaactcggagattgtgtagactgctcgttcctggagatggaccacttctctggggtgtaatgatccgaaaaatatgcgttggagcgatctgccaaagatgaagacgacgaagatgagcgcgacacagaaggacagcaagccgagcttggtcagaggcgtgggcgccatctcgtacaggtgagtgaggctttcgcctggatgactactcatgtcatgtgctgtggcgcgaattatggagctggaggcggcttatcgttttagtgtaacttgctttggtgccgtcggtgcgaccaatgtcttgggtcggaggtctgtatcgtggcggcatgcatgcaaaaagcagtaggcgtgccggtcaggggcgtgaggctggacgataagcatttgaaataaacgcagattcgtggaggattttagcggggataagcggtgctatatagacaccacgagcgggttgtgacacttgccaagccttcaattctgtcacacactcattttttctgtcataattaccttggcctccaccatgcacggtctcgtatgattcaagcacctacagtacagtaggtacagtattgtactggccagtacatacgagcccatgcacattgcagtatataaatagactgtgggtccacgcgagtaaaaaagaggaaaacatgggaggtcgcatggtcgagacgttcaatattggcctagtcttcactccctcttcttcgacgcgttttctctccattcattactcatcatctggtctcgctacaaaaaaatatttgggctaatgcttgtgttcctgcacatgccacttcatgtgatagatgtcattcaggtgctgtgttattggcagggaccgtggaccaagcgattattgagagaaaatgtagaaattggtggggaattaagcaggggtttctggcggtattcacccttctggaataacaataagtaagtagtaattttttttattctactgatccataaggcctacaagtagccgatgctgtcccttcacttcaggtccttctgtagaacaaactgttagttcttgttctcgtacttgtatcacgatttttatgactgaaatacaaatattatcgccagttcaattcccacctgcaccaaatacccaacctcccaaaacctaatgccgatcaatgaaactctgttaaatatttttcagacagccatctcatcatcagcacataatgggcaagtatcctcgaaagaagaacaaccagaacaaccgagacaaaaacgacgacggtcgacgtaagtccggctgggaggacgttgtaaaggagaacgaaaagtgggagaagtactacaaggcccagggtattgttcccgaggctgagtgggatgctttcaagaccgcttgccagtctcctcttcccgtctctttccgagtgaccggatctactgagctcaccgacgagatccaggctgctatcgtcgacgactacgtgccccatctttctggccttgtttttgagggtgaggaagttgtgcctccccagaacatcaagttctaccccaacaaccacggatggcagttcaacgttcgaaagactgttgttcgaaagcagaagcttttctctcgtttccaccgatttctggtgcttgagactactgctggtaacatttctcgacaggaggctgtctctatgattcctcccattctgcttgacgtccagccctccgatgctgttcttgatatgtgcgctgctcccggttccaagaccgcccagctcatcgaggccgttcacgcaggaggcgatctcaacccctccggtttcgtcattgccaacgactccgactacaagcgttctcatatgcttatccaccaggtccagcgtctcaactcgcccaacctgattgtcaccaaccacgacgcccagatgtaccccaaggtcgctattgccgccaagggcgttgatggtgccaagtccaacgagtacctaaagtttgaccgaatcctgtgtgatgttccctgctctggagacgctaccatgcgaaagaacgtcaacgtgtggcccgactggacccccggcaacgctctgggtctccaccagctgcaactcaacattctcatgcgaggaatccagctgcttaagcccggaggacgtctcgtctactccacctgttctctcaaccccatcgagaacgaggctgttgttgccgaggctctgcgactctctaaaggctccgtgcacctgattgagtctcgaggcgatatccccaaccttatcaattccaagggaatgaccgactggaaggtccaggctaagggcaacaaggatggctggaacaacaagggtgacgagggctgcaccgactcctggttcccccccaccgacgagtccatcaaggagcagctcaccaagtgtatccgagtctacccccacacccaggacactggcggtttcttcattgtcgcctttgagaaggccaaggatgtcgaggaggaggacgacaagaagcgagttgccgaggatgaaacccgagacgccaagcgtgtcaaggttgatgctagtgacatcatcgatgctgccaaggagaccgcctcggacgctaaggaggccgttgtcgatgctgctgagaccgtcaaggaggccgttactgatgctgccgagactgtcaaggagaagtttgagggtgttgttgctgaggtcaaggaagacgctaaggatgaggagcccaagaagtccaagaagatgccctacgacgccaacgaggagccctttgtcttcgtcgaccccaaccacgaggagctgcagaagtgctgggacttttacaagttcaacgaccagttcccccgagactccatgatggtccgaaaccacaccggtgagcccacccgaactatttactacacttcgcccagcatcaaacccattcttgagctcaacgccaaccgactcaagtttgtgcatgctggtactcgattttttaccctgcagaagaacgaggacacatgcaagtggcgaatccagagcgagtccgtcaaccgagcctttccctatattggagctcgagttgtcaaaggcaatcttgacatcattaagttcctggctactactgagttccccaagtttgagattctcgagaaggagtaccccgagtttgccaaggaagtttctgctcacaccgagggttgcctgatcctcacagctcagtacaacgatcgagagatctgtcttcccatgtggagaggaaaaatgagtgccaacctgatgatcaacaagcaggacaaggaggagttcctccaccgagtcttcaagatcgagggtattaagacccgaggtcagcagcagcagcagaagcccgttgccgccgagtctgccgagcgagcccagggccaggccgaggctgccaaggctgtcgaggaggcaaagcaggagaacgagcaggccgagattgccgatgagattgttgaggagaatgtcgttgagaaggcggaataaacgactacaacatggatgggtttaggaatataaaaattaatagattagttattagtacaaccatatgaagagcatatttgaatgatgccggatgtgtatctgtacgtgctgtaagcttgtagagtcttttccaggttgtttttcctagacactccatggtaaaactaactactgtacgtactgtattgtacagtatatcgtatacactaccgaatacgatgaactctaaactcgggagctgttgtaccaagattgtattcttgtaccgtagctatgaatgtgataacaaatctgaaaaggatggaaacctatcaagcacaaatatttattgcgcattgattcttcaaacatttttcattcacacaagaacacgctgaaaagcctcccggagcttcgcgattgtactatgccaccaccggagcaggagcgattgatgtgcgtgacaatacatcaagttagacccgcccgagtgataccgtgaaacaagttattccaatacagttcgatactgtgaaacgatgacgtgagcgcaaagatgacattgaaccgcaaaagaagaatgagagagcaccttttgagctatacatgggccagctcatatcagtaagagtcagagcgaagcaaagacacttggagatccacaaatcttatcgcatccaacaaaggggtgtaggccgtggaacctcgaaaggaaagcacacgagctgaaccttcagtttatggaaccagggatgtctcactcgaaacaattgtattgtagggagatccctattcgtttacaatacagtacatacgtatattgtagctactgtagcataattgtcaatgtcctggtatgctaaccgcacggtcctgtacacacagtatatatggtactcggtattgaattgatatcatttttgagttattacttgattggaaaaaaaaaaaaaaaaaaaaaaaaaagcagctagcgctacggatcgggctccattgtgtaccaacacttagttgacaggatccatggagatctggacgtatcgggcgttggagcaagcggcagcagcagcctcaacagccacgggccggagctcccagtggccatcatcgagctgacaagcaaggaagccctggttctcgtaagtcagtcggttgtcagactggtggttaacgttgaagccagtgagaccgtggccgacctggtttcggtcagtccactgcatggaggcctggtttccgagctggacgaatcgaccggtgttggggtcgaccatctgaccccggtaggagagctgggccaggaaggggtcgtttcgctggtcattggagatcatcagtcgaccgttgttgttgacaacccgctggttgttccactgatcaccgtggacacgaagacgagagttctggtactgggctcggccgttaagtcggtcaccgttcaggctaacagaaatggggttggcacaaggggaagcaccggtgaacacctggtaagtgtggtcgctggatcgctgatcgtacgaaatgtcgtaagcatttccgtaagagtcaacgggacaggccaggaactgttgcttgccgttgtcatgctgccaggcgactcggttgttgttgttgaatcgctggtagccaatggcattggatcgtcggtcagacagtgccagtcgaccgtcgtcaacaccaacgtagttctgccgtcggccagtagagttgtggttgtggacaatgttaatatcaccctgaatgtcgacaaagacgttgacagtcttgagaggtgtgccgttgatgtcccggttgctgtttccaaagtacaggtgccgtccgtcggtctgcatggccagatttcggtggtcagagtctcgctgagcgttcatctggtacacgtagtctgagtcgggccactggtagttggactcgtccacgtactgggtagagtacaggtcgtcagagttgtcaccatcgtagtggttgtagccactgtagtcctgagcaagagcagaggcaactagggcgagtgcggcgatagagaatttcatagtggagagagtgaagaggttgtcagagtcaatgtcgatgggtcgatgatctaaagaacttgaagggtttcagggtggtttatatatcttcagatcgattcttccgatcaccttgtctagcctcggataccgataatgtctcatactcgacaagcatctgaccctcgagtaacttgattagttcgagatgaaatttggattgattgggttccgagccttgacttttcaattctctggatcaagtatgtcctcttttcgagtgtccatattcggctccatgaagcctcggaaaggtgcctggaaaatcacgttagacattccaatcactgaatccagaaagccacgtcaatactgaccaggggggtgttcctggtgcctgaatggttcgacaggaggtacaaaaaaagggactttggagaactatcaggaaggtgcagggcaaaaaaattgcagtttaggaatgagaaacaacaggatggtatcctaaaagccggggagaagagagcaaagacattgacatggattttttataccctttgagaaagctgacaatatcatctgtgaagtttcgagtctcctgttactccttgtgctgacaaggaaagtgcaccttacctagagaggtgcaagccaccctacatactgtactgtaacatacaagtgcaagctcagcttacaattgacatatagactagcgttgtataccaatgtagtgtgcagtacagtatgtacagtagtaggatggagtgattcaaaagcagttactgagggtgtgaattcatgcctaccgtatcaactacatacagtatgtacatacaatacctcccgttgcttcttccatcagcatctacgtgaataaattgattccacgtcgagtagaaagagatctctttccaaacattgcttaagtaacactcacatactcaacgacatttatacaagtaccatggtatgttcgttgggtacactacaagtacgagtaattactgtaacatcatcatcagatcacgagactgttacttgtagtagagttcattgtgcctcgtcactctgaggaacactgcgggaaccgatctaaaattggaatcactaacagtggtacaagactgagatttttacctgccattgatgttacatcatctttacagataccaatgactatgtgaaattacatgcatgtgatgtcatcacttcactgattgagttcagttgacaaacgtctgttcaagtattcacctacagtagtatcaatatgtagatatgaagatgagcgacactctacattattcacgtgacaaacgtacagaagctgtctctaaaagcacccaccaatccacacactagcgcctccaactacgcactgtactcaaccgcttctccaggttgccatgaaaggcaaacgcacaaataaactcgtgtttcataacgcatctcgactgtaataggagttgggtttcataatacgacttgtggggggagaggttgataggaaggtgtgggagtaatgagttatagacggatttagcccaggaaatgtcctttaaagatacagtcacgtgattcctctgcttttttgttcacctcatggcatgtacaacccccatctacaccgcccagcatagcctccataacactaagtgcacagccgtgttggtcccaagctaacttggcatggtctattttgggaacatagaaatgtggcaccgtagatattatatagagtgttgacctgtcattttcattgcttgtaatcatactgtttatatcacttctggaagacctataactgatacaccatctgcagtttcaggcacgcaataccgaatcaacttacacacacagttccacacacatacacacacacacacacacacacacacacacacacacaccatggctccaatgatccaactctgtccacaggctatggcccaaccactcatcagcttctcaaaaagaggattagcagaaagtgccaaatcaactggagaagctttcaagagctgggatacatgcatggataacacgttttgcaagattgtggcgattgtgggaattgttctgggaggaatgctggttctgtgggtactcacagcctttttcagatgctgcttctttggagtatctgctttcagcgcctgttgtgcgctgtgctcttgctgtgcctgctgctgtaacgataagatcaacagagaggccaaccaaggtaactacgcagcagcaaataacccagccatgtacccagcttcaaatccttaccaggcatacaattatcagccacagccggtttacggaaaccagtccaataacaactttgctcctgactattatgtgaacaggtcagtggacgatacagactacgagatggagaagtatccaaagataaatacctatgaggttcctgctgaacaggaaagaacaagattctaaccagatgcatgagcagaccatgccaacataagcagattgcatgttacagtagttgtgcacaggtgcgatagagatacaaactcacgcatagctatatttgacgattgacgcaactaacatgaatgaatacgatatacatcaaagactatgatacgcagtattgcacactgtacgagtaagagcactagccactgcactcaagtgaaaccgttgcccgggtacgagtatgagtatgtacagtatgtttagtattgtacttggacagtgcttgtatcgtacattctcaagtgtcaaacataaatatccgttgctatatcctcgcaccaccacgtagctcgctatatccctgtgttgaatccatccatcttggattgccaattgtgcacacagaaccgggcactcacttccccatccacacttcctcaaaagtcgtagtcctcctcccagttgctctgcttagcaacgccctgagggcccagcttctgggcgtactcaaagggcgagtagaagttgagcttttcctcctcgacagttcgtccagactcggcagcccgacgagctgcctcctgctcaatgtacaccatgggatcctccagctgtttgtctccagtctcggtatgaggatgaatttgttcaggtggaggggcttcatgatgaacaggaaggggagcagtctgttgagcctcggactggaatccattctcctgagaagcaccctctcgaagtagctcgtctctgacttcctctcggatgtcctctccttccttgttgaccaatttgtctccatccaaagtgacttcgtggttgccgattcgccgcatcaggttcatgaaggttgacttttcaaacttcgacttatcggcctcttccagcgaagacgcaatctggcgcgcaatcgatgcaaactcgccgttctcgtccgtcttgatatccacctcttctcgcgaaatattgtccgaaatgtgctcggcctgtcggttgagagcgtcagcctggtcgtagcggtatgtttgctccatggggtccttttccacctccttgcccttgtctgacgtcttggtgatggactcctccactgctccaaaggcggcctcgaacgctgcatcctgggagctcttcgtctccgtcttgtgtgtctgctgatgttcggtttgaaggccgtacgtggagttcatgagctgtgagttggagtacatgggtccaaagctggacataccagacatgctgcccatcacaccgttagccatctggggctggacctggtgtgactggggactttgtcgcataaaatcttgaccccagttggactgctgagtatgctgagggccggtttgaggacccaggttcagttgactgaaagactgggcccagtcactttgttgaccgtgtgccatgggggcgtgctgacccatctggggttgatggggctggccaaaatgttgctggccaaaatgtgggcccatctgagactgttcaaatgagttatgggccggtcctgcttgggcaaactgctggaactcattgttgagctgtcctccttgggtctgagatcgaaactgctgtcgctgagcgccaggagcgccaccgggggccattcggtcatgctgaagcgatcgatctgctgacgcatgtttcgacaggttttgtagggcgttagaaggtccgcaagatgccatggttgtgtgtgtgaatcagcttgcgcgatgtgtgtggtgtatcaggacagttcgagtctgtgttgtgtcgtgagctccttgtggttgcgtagctcttctctccgtctaactgcgctcagtgactggggtatggcgggtcaagttgtctgtcaagctgatgtctaaatagttactgtacttcagctgtcgctagctttaggttgtggttatatttctgtggggttcggtgaaccttgtgtccgtgaatgaatgtggagaagtgagaggtagggtcaaatgtggggtacgcgaggggaaaatgttcagattttagataatcaatacatttggaaccccatgaaaaatacacacagacccttattattcttacacagtcgccaccaagcccccaaattatacctcggttacctgtcggaacttgtctggcctgattaacggctcgccgagcctatttcataaaagtttactaaccatcgtgatttgagatgagataccgaggtacaggcgaaggggttgtcacgtgatagagaaaccagcggtgaagtgaagtttgtagaaattgttgcagctgtgtactttagagatctgctggggtgagctttactactcgtattgtacttgtagtagtgacaccctcaacaaacgtaacttacttgacccctttggcgtttttgccggggatgccgtgttgcgggaggagatgtacatactgtagtagcattatagaagcaaaagcaattccactttgtagcagctcacctggagattatatcgatgtgtatatattacttgcagcatgtgtgtagcagtagatgaagtatggacgattcataacgaccaatttcagttttcaaagctagaaagaatgaaagccggaggttttcagaaaaggaatcaactacttgtagcaacaacggccaatattgattttggtcttcttatcgcactctcgactctcagaaacacacagctctacagtactgtacttccttacaatgaaggcggcttagtaactccctcaactctatgttgtccaaacatgtccttgtaattggtgaaggagacgtgccactgacaaagtcaaatagaggacccacactcaaatttcatgatcacaccagatcatccttttctttttctgagtcgtttctgtggcattcccgacagaccccctccaactgtcccctctcattggtcacctttttccaaggttgggagttagcttagtcagaatagagttccgtcacagcaaatacaattgggcaacctccaagtgacgcaggaatatttggtatttggatatactagaatcaacatggccagccgactttttttcaaggtgagtatcgaaaccgtgcccgctaatcagttcacaactaacacagaccgcaactcccctgagtttcgccgcaattgccgtggcttctgctcccgtggcctttgctgagtcgccccgacgatccatctacgacaatgacaagaaggaagaagaaatcgcccctgttcccggcaccgttgagactggcaaggcccgagagggtgacattgagaagtttgagaaggagcacggcgtttctgtggagaacgtcggaggagtgaccatcaagtctcccaaggctctggagagcaacatcaaggtggctcgagagtggtttgccgacaaggtgcagcagggcaaccagtacatcgatgaggccttcaacaagtacctggccgtggagaacagcgtcaccaagaccgtggccgacctcaagtctccccaggaggatattctgcccgccggcatctacatcactgttgctgctctgtccggctccattctgacccgaaaccgaaacattctgttccgatccgccattcctctggcctttggtgtcgctgccttctcctacttcctgccccagactgcccacaacaccggagctcttgtgtggaagtacgagcagaaggtgcccgaggtggccaaggcccacgtggacgccaaggagtccgtggacagcttcgccaagaacgtgcgaaaggccctggacgatggaaagacctctctcgagagcggagtccacagcacacgaaagttcattgctgacagcaccggtctgcagcttcccgacgttgacgagaacgacaagaagaaataggaggatggaccaagagtagtcggtcagtgtttatagataacaatgcacatggatggagtgaaagtgtagagggcggttgtgactccttggtgtgtatcgaagagtaccgtacaatcggggaagagggttctcttaagccctcgaactggggatgaattttcggaatatacatactgtactttcgtacattgtaaacatgtaagttgatagctaccgctgggcagctgttgattcgattcggatggctatggctcctttggtgcccttcgaacacagtatatactgtagtgtaaaggcccgcatggtttccagtttttggtttctacaaggtaatgttcttctgttgcgacgactactttaacaaggtagtgattgcgatagtccaggttggtaatacagacaagtgcagccatgaaagctattcttttcagggggaggacatgccaatcctgttgcttgtagttggctgttactgtatgtttagctaccgtaagacgcgtcctcttttgttcgctttaaaggtacagtaacctcatcgattgtgtttactccaccttatttgtgtcaccaactgtacaagtacgtagctaccgatacttatagctctctctttcttcctctactttatcaagctctcaaaaagacaccgaaacacaaaccagagggatacggacacagaggcgacacagagacgacagttgcaattaaatacctacatatacccctaaggccacattgtcggacttctgatacttgtgccacgataccacacctggttacccgtgtcacgataccagtgatcacgttagaaacattggcccgaaaccatcgcagacatagccacagtctcaatgtcgtctcccaagcgcttctcattatttcgatcgcgcgaaaactccgtgagtcggctatgcaaagacgtggagagctcgatcaaggagtttgatcgccacctgacaatgcaaaaggccatcacaaaccgaatcgagttctgggcatcgacgttggacgatgaggagatatctaaggacgcagaaaagctagcaatggcactcagagagtactgggtcgaagaagaaaagctcaagctggcgctcaaacacttttccgacatatttcgcaccctaggatgcgaggaggatgcgttgatccagtccaaggccaagctagatgccgcagagaagcaagtcgaagccgtcaagctcaaggcgcggaacaaggaccccagcaaggtaattcacgatcatgatatgatcgccaagtcgtcgattctgcactcgcaggtccgggcagccacaaagacgacgttcatccgattcaacgcagcagctcaacgtgtacttcgaagggcattcaccgagctgttctctcagtttagagaggtaggatgctcacaacaggatgtggtagtacgtggatggactattggcaacgggattgcgtgtcccgacgacgatgagccacgtgataccatacgtactatgaacattgggcgatccaagtcagtacaagacttcaagagtgagtcggttaaggagagcagggctcgaagaagaccggtacctgcatccaccggtagtattctgcaccgaagaggcagtgcaggtgtgatggagcctagtgcattctctgctcccattgcgaagacacccatgggtcgctacgatgacgggtaccatttcaggggagggatgctaggagggatggggagtgcatcgtacaatagtcacgcccggtcgacagttccggcttcggtaacgagcactccccagtcgagccggacgcccctgtccaaccagacttcgccgtttctgtatgctcctgccatgcatcctgttgatcgcaatttgtccgacgaagcgatgcagtggaatgaggtggcagaaggatggcatcacgacgagcgagacagggagcatgaaagagttggagatggaactccgttggtttaagtatgtaagtagagcgtgtagatatagaatagcttatgtgtactgtgtcggtgtgtaaggatagctgtaatggattgcatacagagctgctcggaagctcattcgtttgattgagtatatacaggacaataaataatctagtctatctagggttatgtcagaacgttgtttccgttcattttatcaaacagttgtttgccgacttcgtaagacgaaatcatgattgcacacgagggagctacctttaagattcgaggcacacttccgacatacagagatccgagtccctcttcccgaaccattttagtgagcagtgggatcatggacatttggccagctgattcacaagatgcaatttgtcgtctggtctttcccacatcaaatggttgagtgatgatggacgccagagctccagctgccgacccagcaatgaaagaaggggtaaaagcatctacacttccgtggaagtattgtgttcggaggagttttgccttgaaggtctcgtaggccgaccagtagactcctgagaagggcacgtctctccacagggtgagtaccagacctctccacagagaccggtatccgtcctgggcaatcatggttttcatacctgtgagtgttttttgaaacgccaattgcgacgacgattcaaaggggtatgattgtaaacgtgttctgaagagttccatgggtgagatgactgtagcagaaagagttcgggcaagagctccacagaccagaggattaataacctccgacctgataggcgaccagtctctcagatactcgtatccaatgaaatagagcaccgttgaaggtgctgccatcatcagagtgagcgacaaacctctccagagtgcctggattccctcgtatttgtaaatggttcgcattccctgccaggttcccgagaatcgcatctgtttggcatgctctacagcacaccggtccacttcggacgctacgcagtagtccaccgatgtggggaaccaaaacacctccttgcagcatgctgtgacacccaggccctttggtagggtggcgacattgatagggtgtagcttatgagccttgagcgcagacaggtttgttttaggcgatggggcctcaattttcgagtgcggaggtagcatgttgggagcctgggcggcactctccgcagcagacagtgcgctttgctgttggagtcgcacacgcaccacatcgaatggtgtgactattagagacgtgatgattgatccggtgcatgcagagaggattttttggcctaccgtcaccgagggcacgggaggtgtcaacgggctggttggaggaacaaaagcctcgtctggacgatgctggtggattttgtgtaccagaggtggcattttggggtggtgagagtgagaagtgttgtgttgcggttataatgtcttggttgagtgtaacgatgtaatgtccttggggtgctgtttacaaccgtcaccttccgtgtctatcgtcttgtgtcgttcgtgtcgcttgtgactctaccgcacttgtgactcctctgctgtaacaggtctagttcaagtagaatgatccaccgcggactcttgccaaatgttggtgctgaaacttctaactctatctgtcccgtgcagtggtgatggcgatgtgcagtcacgtgggacggggactggtttgggagcaagtcgcggtggtgtgggtcgcacaatgttatataagtggggcgcgcatgtcgaaaaaccgcttccgttatagctacgacgataatgtggctctctatactggcagtgtggtgcacccatctgtccatggcgtatctccgaaccgtgcgtctctcccaacagttcgctttaactatagtatgtgcatgtacgatatctgtcagcgggaaaagttactccatggacccaaagggaaagttactccagctcgttgggagcgaggatgtaaagggcagtttagtgcggactggagaacagttctgcatgcggatgactcggaatgattcggggtgtcaagtgcggccatgtactgtacgtacgatattcacaggtgtcggcataggcttggttttgggtggtgttggatgattaaccaagaatcaagtcttgttaggagtcggttggacatggcttagagtaacacaagggcactatacatggagggataatggaggacaagagatatatatgaagatggcgatgagatataacgagtactcagacagttctggatagaagttggttgaatgaagaccttgtgacagtatgtatgagatccgaagatccaaggccatggtcacctgaatcataattttttcgacatcaagatatcaccaatgttgacccaaggacgtcattagtcattggactattttcggcctgtggagatagtcacctgtaggtacagtacagtacatactatacgacgtacggtatgtacagtatgaaaccgtgcacgcgctacaatttctcgtcaagtacgactatcgtaagtatgtactcctcaagttgaacctccgaatacacttcgaccgcgactgaagccgccatggtacgataggatgtctgggtaatgatcaagaaagcgaaatgacatcatactccagggtcagctcagcaagcccgatttgggctgttctgacttcccctgatttacatatcttcagtaaatattacttaaatgttgtccgctatcgacccactcgtatcatgcatgtcccatacggcactggagatatcgacggtgtagaagcggccaatgcaccggtatttgtacaatacacagtacatctagtgacatcatgtatcgaggcaaaggacagtcccacgacgaaggtggtcatgtgagtctaaccatccacaaatcggttttttttgttcattttattcacgcctcagtttgtcgacatctcactcactccaccaatagtagaacattaccccatatcgcaatctaaagtgttcactcctaatggtatgcagcgcactcatatagtgtctcgtgacagcgatagatgggagtacccaagtaggcgtacacatacatttttagacgggaaaggcggttaaaaatatacaccatgtcccactaccacaaaaaacgatctttactgttgtctaaatcacctacaacagtctcaactcaccagtcctcaagtctcctctaaaccacctctcaaactcaaagtcacacctccaccactacatcaccgcacatcacaccagtcaccccatacttgcacctcacatctctgacatgaacggaagtgtgacatcggtgcaatcggtgcattcgccacaacgccggatggaagaggatgagacggtcaagtccaccgcttccaaaacctatgtgcgccatggatttgacgacgactacgccagtgacgcctacatgtccatgttggccgaaatcttttacatctacctggacgacaaacgccacgacactgcgggcaatccgaaacggtcttctgccgacggcccgcccgaatggcgcatgaaagaccgacagagaacagtgtctgcagccattgtggtgtgtctcaacctgggagtggatcctccagatgtgatcaaaaccgacccctgctcgcgactggaggcctgggtggacccacagaccatctcagactccaagaaggccacggagcagattggaaaacagctacagatgcagtacgaggtgctgtcaatgcgaacccggtataagcagtcgctggaccccaatgtggaggacattaaacgattctgcataggactgcgacgaggtgctaaggaggagcgaattctgtttcattacaatggccacggagtgcctcgacctacagcttcgggcgaaatctgggtcttcaacagaggctacacacaatacattcctgtgtctttgtacgacctgcagtcgtggctgggctcgccatgcatctacgtgtgggattgccatagtgccggcaacattgtctctaacttcaagcgctttgttcagcagcgtatcaaggaggacgctgatgcacaagcacccaatggtgtgaccagtgcagcttcaggaaacggaaatgcctacctcgattgcatccagcttgcagcctgccgggccgacgagactctgcccatgcacccagaccttccggcagatctgttcacgtcatgcctgacgtccccaattgaaattgctgtgcgatggttcgtcatgaagtctcccttggcttacgggaagaagatcaaggatctgcaaatcccaggaagaattaccgaccgaagaaccccccttggcgaacttaattggattttcactgccataaccgatacgatagcctggactttgttgcctcgcgacctgttcaaaaagctgtttcgacaggacctgatggtcgcagcgttgttccgaaactttctgctggcagacagaattatgcgggtcaactcatgccacccagtctcggaccctcctcttcctcccacccattctcaccctatgtgggatgcgtgggatctagcagtcgatcagtgtctgactcagttgcctgctttggctgctggacaggagtatcgccactcgcagttctttgaggaacaactgacagcctttgaggtgtggctgcgatacaatgctcgaagtgataacccacctgttcagcttcctgttgttttacaagtgctgttgtcacaggtccaccgactacgagcgctgatcttgctctccaagttcctcgatcttggaccctgggctgtctactcggcgctctctatcggtatcttcccctacgtgttaaagctgttgcagtcccccgctaaggagctaaaacccgtgcttgttttcatctgggctcgaataatgagcgtggaccatcaatccattcagcacgagctgctcaaggacaatggctacgcctacttcatccaaattcttctcccctttgaaggatttgccgttaacaacgtgaacgtccatgaccacagagccatgtgttctttcatcatcgcactattctgccatggtttcaagcagggtcagcgggtctcaatgggtgctgatcttctccgggtgctcgtggtttacgcagctgagcctgactctccactgcttcgacagtggtcctgtttatgcatctcccaactgtggttcgactacctagagggcaagtggcttggaatgaaggagagagtgccccagagcctcattgtgctgcttgaggatcctgttcctgaggtccgaacagcgtgtactgttgccttgactgcattccttggcaatggagacgctgatcacatttcccaggatttcaaggacgtggaatgcgagcttgctaacgctgtcctcaagctgactgacgacgccagtggtattgttcgaagagaagcagtcgtattcttttcgcgtttcgtcgtccagtaccaaggtcagattctggttgctgcgtttgctactctcgagcaagaagctgctgctgtctcccagatgaacctcaacacctcgtccaatcctgccaccggtaccgtgtttgctgccgtgtgggaggccgttctgacatttgcagaggacccgttcaccgaggtgcgtgactttgcacgtgacgtggttgatcacgtcttgtttgagatgggccagtcgcctctgggacctcgaatggagcagctcaagcgaaccatgctgcagggagccgagtccaagaaacagctgcctagcgtttccaacctgattccttcgtcagagtcacatcatcatgctgctggtagtcctgctccccaatctcctgcgatggctcctctaacgcctactgcatcttccaccattcaaaatgccattgctgccgacagggcagcttcttctcctctcaactcgctcaagaggtctgtctcgaagtatctatttggagacaatgagcccagtggaacagcagcccagaaaacggactcatctgttacaactgttccttttggcacgggaaccatccccgtgacacctcgttacacatcgcgagctgcaggatcacgtgctcaactccctctgaagtccgggttttttgcttggtccacggagttcttccaagagcctcaaatggtgcctgcggaggccgactgtactggttcacagcggtacactgagagactgtggcgaaagacccgcaacgagagaattatctccgagtcggtgcttcagcgagacgaagctgtcaagggcaagtgggatcactctctaggtgttctcagcaacaagacgcagcctcagaaactcgtttttgcgcagtttgagccacatctggcagtagctgacgaccgagacggtgtttctatctggaactgggccgaaaacaagcgtctgtcgcggttctgcaacgccaatcctgcaggaaccagaatcaccgacgtcaagtatctcaacgaagacgacgttcccatgctcctcacagcctcctccgagggatgtgtgcgaatctacaggcactacgagtcgcgtcaggatgtgcagttagtgtctgcttggagagctctttcgggagtcggtctgcaggcctcttctcccgtagctgtagattggcagcagtctcgaggaacactgttggttggaggtcccacacgagtggttaaggtgtgggatgctccccgagagatgtgcatggcttccattcctgctcggtcttctgcccctgtgactgccctcacctccgaccaggttgctggtcacatgtttgtggctggtttcgcggacggggctctgcgtctgtttgatcgacgagtcgattctcgagacgccatggtcaaaatctggaagctatctcgaggtatcagacactctgacaaggtgctcaacgtgtgcatgcaacgaggaggacaccgagagctggtatctggttcggcagacggagtcatcagtacatgggatatccgaacagacactcctctgcggtcttggattgcacacaccaacggcatgaaggccatggacgtgcatgaacatgcacctgtgttggttacgggctctcagttggtgcgaacgtgggactttgatggtcacatgacctcggtaaacaagaaccaccctggttatatgacccttcccaaccgggtaacctcggttaacgctttgtcgtttcatcctcatcggctggtgatggcatctaacaatgtgaatgacggcactgtgatgttgagatcgtgttcgggctttctcaagagtgatttctagttagttttggctatttaatgcattttaattgtaccttaggtcaactgcatagttccggtttcaatatattgtacaactgcagcgtataccataagtgtacgatactcttcgaccacctctacacctacagtatgcactatgtactacagtatctgactcatcttgaacttacccaatccaagtacacgggttcatactggtatacacataaatatcttgctctatatacatacggcctggttcagacctaattttacgcgtcgtttttaccacccagatgcttgttcttgtgaacatacttcaacaagtaaaaacacacactgttagagatgccctcgattcgcttagcttgtccgagagtggctggacgaactttatcgagaacggttcgatactcgattttgagacccgccatggacatgtaatcgaggttctcaggaagcttcaggctttcatctctctcgacagaagcaatctgctggcgttccttatccaagtacatcttgtatctgtactcggtggtgactcgaagaatgagacgaggagggtacttactgagctcaggcatggtggcaaacaggagatcgtcatcaatgccttttacaaggagcatgtgggcagcagtcatctttccttcgaccagacgagggaaaaccttgtatccgagctgttcgttccattccgtgggggtaagtctcttcgactcaaagattttcttgatgtctgcaatggcctcatttcgctgctcaagtcgggagactcttctagaatcaaccagacctcgctcaaatgcctttacagtcagtcgttcatcagcgttatcagctcgaaccgaaaatcggaattccgagcgggaagtgaacattcggtagggttcactgactcccttggtgatgaggtcgtcaatcaacacaccaatgtatccgtcagagcgtcgcatagtgaagggctccttattctgagcctggagacctgcgttaaaaccggcaatgataccctgagcagcagcctcttcatatcctgtggttccgtttatctgtccagccaagtatagaccatggacgagcttagtctcgagagtgttcttcagctctcggggatcaacgtaatcgtactccactccatagccgggctgagtcatagtcacattctcaaacccaggaatagtcttgagtacctggagctgggtctctgcaggaagagtagtggagataccgttgggataaatagttgtggtgtccagtccctcgggctcgacccaaataacatgtgagtctttatcagcgaatcggatgatcttggattcgatactgggacaatatctgggtcccttgacatcttctcgaatgtggatcgacttgtcaaggttatctcggataagatcatgagttgccttgacagtcttggccttgtagcacacaacagagtggttgtttggtcctcgcagctcggcaggagtttcctcgttcacagagccatcggtttttgcggcggggacatcgtcattgaggtatgaaaaggggaaggggtcctcatcctggagctcgggaagcatggtcgagtaatcgatagttgtggagtctattcgaggaggagtacctgtcttgagacgtccaagcataaatccaacctctcgtagagtattggaaatgccgaaagtagccttttcgcccattctaccactaggataagcctccagaccaatatggatctctcctccgaggaaagtaccagtggtaataacaaccttttcggtattgatagtctcacccgactcgagagtgagtcccgcaatgcttccgtagctcttaacagcatcaggagtcgcctcaggggtggtcaataaatcttccacggtgccctccagaacctctaagttgggatagtctctgatgagctgttgcatctccttcttgtaaatttttcggtcgatctgggctcgcagaccccacacggcaaagccacgacttcggttgagcatcttgaagtggataccagccttgtccgccaccctccccatgagaccgtccatggcatcgacctcggtaaccagtgttcctttgccgattccgccgatactgggattgcatgagcaggtaccgatattgtcgaatttgggcgtcaccagcagtgttcgagctccagaccgagctgctgctgcactggcttcacagcccgcatggcctcctccaacgacaacaacgtcatatttgggcgcagttttgagtgtttcgacgatatcgggagtcgtatgaatcctcctcagctgtgggagtcgattattgccccgaaaaacggctcttacttgtgctcttaacatcttgggggtattgtgcagagttgaaagagagtgattcagattttgaaaattcaagattgagtgctcataaaaataaagttaatgcacagttcaaaagtttcagtgaaatcgtgacccagctctgagtttttttaattcaactaaagatgcattaatctccaaaaaaagggagatattcaatgagaacataagccgaaattaccatagagctcttatgggaaatgtaagacttcagatattgccgaaagggtcttttcaacacgagacttttctcttggcttttccactgaagcttccagcgaacattatgagtgaggatgagacgtaaatgactctcgtactcgtgaggtcaccaaggagtgacattccgtactgtaatattaacatccttcttctgcattttccacgttatcggtccaaaatatccatttatacatgattgcgaccatatacatgcaccaacagaacttccaccataaccgcaggactaacagacactctttacatatcaagactttgataaaaatgagaaaagagagactagatgatattgtaatttttaaatgtactatgatatgacatttatatccacccagaagctctggaatactcattttacaaaaaattaacggaattgagctacactagtccatgattaaattcttttcagaaatcggtcccttggcccagttggttaaggcgtcgtgctaataagaaattagcctctttgcaacgcgaagatcagcagttcgatcctgctagggaccattttctccttggttgtatagtgtagcggttatcaccttggattctgactcttgaagtactttccagtaaccccggttcgattccgggtacgacctttttggtgagcttttaagggttcatcctactatttttgcccacctcctcaatcccctacactggtattcttttcccgcacctcctccactgctgtacgtggaatgaaagcgatcgacactcaaaaaactcccaagccttattcttatgcacccgtgtccattgtcggagataacaagaggtaaaacaatggacgttattccaagccgcaccccaacggttatttccggcacaggaggaccagtatagacgtttgagatattttgtatcttatgcggaattacggtgataggatcggtcaattgcgccttttcatcaaaaccagactttcgaaactcccttaattgctctcgtccatttcacaaagacaggctactgtagattgatccggaaaaaaaagtgtatcgtggagtcctgtcgaacctaagcgctgcccctcaactgtaagtcgcggaacctattgaccaaagcataggatggtttcggagctcggagttatgggcagtttgaccattgttgataatgacagtcgtccgttagcagtccggaaagcctccaagtcccgtgcttagactgaacaggtttgagcaggcgtcttcttgcagacatctggtgccccgaacgccttgatagcgactacaagcgatgctggtgggaaccttatccgtcttggctgcatgcttgcggtattataagaaggcttggactcgtcgatacgtcacatttggagagctacaaaaggccattgacatctcaattgaccgttcacaccaacaaaacacacccaaacacacttgacaccatggctgaattcgaagaagacgttgtacttgaaaagtactggcccgaggaggctgcccacgaaggaaagtccgcgggctcaacggttcccctgtcgcaccactttgagggccccaagcacaacttccccggacttgagatgaagatgggagccaccggtgtcatctggacaaccgaccgagctgctgagaagggcttctcccatgagaaccccgaatgggccaacctcggtcagggagctcccgaagtcggacctatccccggatgtttcaagcgacctgatgttatcgacgcttctgaggagtctcgagagtacgcttccaccgctggtgttaaggagctgcgagaagctgttgcaaacctgtacaaccatgactaccgagagggcaaggagtcaaagtacacctatgagaacgtgtgtattgttcctggaggacgagctggcctgatccgaattgccgctattctttcggatgtttacctctccttctttttccccgactacactgcctacgccgagatgctggctctgttcaagaacttctctcctatccccgtgcctctcagagccgacgatgactaccaggtgcatctggacatcattcgagctgagcttgaccgaggtgtgtctgctctgctgacctccaacccccgaaaccccaccggtcaggctatgcgagaccaggacctcaaagatctacaggatatgtgccgaaagcgatgtctgctcatcatggacgagttctacactcgatacaactatgaggacggctgcaacggctcttccgtctcttctgctgccaacatcattaatgtcaacgaggatcctgttcttattgtcgacggtctcacgaagtccttccgactgcccggatggcgaatctgctggattgtcggacccaagtcatacattaaggccctggcttctgctggttctttcttggatggtggatccaatgctcccttccagaaggctgccgttcccttcctggaaccctctcttgtcaagaaggagatgaccgctctgcaggtccatttcaaggccaagcgagactactgtatcgaccgactggagaagatgggcttcaagttccaccaagtccccaccactaccttctacatctggcttgacctgagtcctctgcccaaggagatcaactcttctttgcactttttcgaggcttgtcttgaggagaaggtcatcatggtgcctggaatcttcttcgaccttaaccctctggcccgacgagagatccaccactccccttactaccacttcatgcgactgtcctacggtcctcccatggagaacctggtaaagggtatggatgccattgagcgagtcatcaataagtacaagaaatagtcatcttgtgcacatacaggtatttaatcttatagagaaccagaaagaactggagtgagagtagacattactcataatgagctaaggcgagatcgctgttatgtgacgtacttgtacggggactgtacatactgtacttgtaaggtgcgaaggaacacgacgctcaactgtttgcaggctgaactcctgacgagacacatcttgctcacagtcagattagcagccgtaagaagcttgagttgatgtgtcctgaacctaacaaaaccacggagtcgtttggtgtcacgcacaagacattatccgtgcaatacagtgctgaagaacctaactatcgctacatacttctttttcattcacatcttcattctttatttagtgctcaaagtattccggtactggatatacgcggggactgatgttagtcaatgttttggataccaaaaatcagtggtgtaagaagttcaggaaagcagttcgttacattaagattcaaaggtaagcgttggaaattgcataaaatgtttcatcatccaagaagctgtcgtgttgtgttactcaccatttggttgtgcgcgtgagatgtgaaaaaacaaatcgcgagtattttatagacgcttcgagggttaggggactctactaaacgcaggagggtaatttggaatatagggcatggaatataaaggtgttgaaaacaggttaaggatcggggaaatggcgcaaagtgttcaagacagatataactccgttgtgtgaaattatcccgccatttggggtactttggaaaagtccaagtcgaatcttgttgactcttcgacaagctctaaatgtagttggcgtttttgttgaaataagacgtgttgaggaaataggcagacataaagggctgtttgggagctggagaatagaaagtgtctaaaacgatatcccccaatagatatatcaagttattgtggttacataacccgtaactgcttccatgagcccacaaagtgagactcgggaaggaacgactttcggaacagaacttctacaagtagttggattaggttcaatctacagtaaccttggggcatcttggagaggaagaaaatatccatgttagtgtacagctcggagttcgcaggagggggttgagatcttgtcaggctcatataagaaagacgcgcaaacttcagtactgtactgtacagtagtatcaaaatgtgcaagtcaactgctcattgtgtcacggattatggacaatagatgatagctgtctcagcccaacaagcaaacaggctccactttcagccgcacgaagtagagagaggaacgagtgtaagcgtacgtacaagtaaaaagtaacatgacgactttgtttatggataattgaaaagtttcaattcgggttcttttttcgtaatatcttcatctcttctgatctcttctgatctcttctggagtgtgcgtacttgagttgactggttcaggttgtgttcttagaggggtgttttcggaagcggtaagaagtatccaatttgacctaaaggagaaagatgtattaaaaccagattttctgatgtaaagaactcctcaaattttctgacaaattactacagctcaagttatatacacgccccactcgaggctactcggaactttaaaccccacatgactccaccttcgggtgcaagcacacgaatatgatgcagtgacttaactgcaacttgttgagacacagcacactataacacaatgtcttttgcacacctactccccattgacggcgactggaagaccgacgtgacccgatggatgtctgaggacgtgccctcgttcgacgtcggtggatatgttgttggagacgacattcaccatgccactctctactgcaagtctcccggagtggttgcaggtgttccctttgcccaggaggtgttcgaccgaaaccagctcaaggtgaagtggagcgtgcgtgagggtgactacgtggatcccaagggtggcaaggttgctgttgccaaggtgtctggtcccgttcgacaggtgcttctggccgagcgaactgctctcaacctccttgctcgagcctccggagtcgccacaaagtcccgacacattgtcgagctggccaagaaggctggctacactggaattattgccggcactcgaaagaccacccccggcctgcgacggctggagaagtacgccatgattgtcggaggagctgacccccacagatacgacctatcgtcaatggttatgctcaaggacaaccacgtgtgggccactggatcaatcactgattccgtgaagaaggctcggtctgtgtgcggatttgccatgaagatcgaggtcgagtgccagagcgaggaggaggccaatgaagccattgccgccggtgcagacatcatcatgctggataactttgacggcaagggtctgcaggtggctgctcagagcatcaaggacaagtggaacggtaccaagcacttcatgctcgagtgcagtggaggtctgaccgaggagaacatcggctcttacctgaccaaccagattgacatctactccacttctagtatccaccaaggaactggcattgttgatttctccctgaagattgatcataactaagtgagttgcaacatgattgcgtaacacaagtttggtgatcatgcaaggaggtgtcgatgcctgattctacaactgccacttatgagtattagaccactacagcactgatcggtgcatctgtaattagcaatatatctgatttatacgtgcaaagcttgttacatggttacgccatgtctgggtatatattgttcttccccttgataatcttttcaagtcttctatgatgatactcctacaggattgcagtgatgtttttcgatggtgaaggatgtccaaaaatccctgtgggggcaatacacagcttgcacactggacgaattgtaacacaggtctccaatatagcataattaacataatcatttcataaatatatctcacccctcctcttagttcaagaacgaagtgaagtccaggctcttcaacaagggcaagtcattaccggtatcttcatcttcagtaaaaacaggtccagacggattatcgtcgtcatcgtcatcattgtcgtcaggtgcacctcctccttgcagctgttcgaggaacgaggccgccatatccttgctgtcagtagcagcattcttcttctcagctgctgctgcctcaacctgggccactgtcttctcctttagctgctgaatctgctgcagtcggtacctccaattcgacacatactgaccgtcggagtaccagatagttgcaaacttggaggcgatcaaaacgaggtttcgaatgaaatcaggcagagagccttcggagatgatcttcaagtgacaggcagcaaaaatagcaggcactcctgcctttcggtaagctcggaccttgtagtagcgagtgggctggtctgctggggtcttgggctcgtccttggtatctgcaaaaatgtgagacttatcgaagttagccgagtgaggcgtgatgacaatgttgatgaagttaaactgagacttgatggtattgaaatcaaaagtgagtccagactcgtcaaagaacacgttaacatagtcgttgccaatgtgccgctttttagaagcataggcggtatcttggggattcagagggggaggcatgagtgtagtggcatggaaaacaagctgtgaaattttgtctctccagcagtatgcaaattcaccatccacattctgctcggtgtcgagtccaccagtgtagatggacttgttatccttgagacgggtcagagtaccgagagaagacatgaactgccggtaatgaagagatccagtttggttagccaaaatttccgtctcttccttctgattggggcccatgtacatgacaccgaccttgtgaaaatcaaccacagggatacggtcaatagcagacaccgctcgagtagtagcaggatctgtaccaagagcaatgggcttggggatatcggctgtgacatcagtagggagggtctgcaaaaggaagtagttgggggaaaatagctcttcggaagactgctcagtctgagtctgtcgagggaccatcttgtcggaggggttcacattgatgatagcagtgccggtgggtcttctgacaatatactgagtttctccagtggtcagaacagtctggatggagatgactgaagttccatacagccactgctttgtggaagtcttcttgtccttgaggtgggcattgatacccatcatggaaggcatctgaagatcgaagtcagtgaaagcaaatcgctgaatcagatcaagcagtgcaagagactggggatcgatgtcggcagggtttccgtctgccaaaatgaggtttcgcacaatgaacttagccagaaagtgacgtttggaaatatcgagtttaaggaaccaagcgataatcacgttgtaggccagagcaagcaaatactggctcatgacggtgccattgaactgagtcgcatcagtggacgactttgtatccggaccagtggggtcatagttgacctgatgtttcgatccatcgctcattttggccaaatcgttggcgtgctgaatgtacttgaaggccatgccgaagattcgcttgtactcatcctgagtgaatgatcgggtaagagagggcattcgagatagggcgaggagaaactcgagaatgtggggagaagaagagagagtagtgatcttcgtctggaactttgtaaagatttggggcaggaatcgtcgaatagatacggggaactcgtaacaacatagaaccagggcatggatacagggaatagcagtcttttcccatgacgacaagccagccaccaatgcttgaagaatatactcctcgtctgttctcgacagaagatctccatagccaataaaggatgaaatgtttcgaataatggccactccgatatcaggcttggaaatgtccttggggatcttcaacgcagcagggagccggtcggaaataccctcagagagtgccactctaagagccttaatgtcctgatgcgaccacttgaacaatgccaaattggaaagctgaggtcccaaatgagccaagacaaaagagtaaatctcccagtcacactgagccttgctgatgacctgtagaatctctgagaaccaaagcgatgtgtcgatactgtagaccccgttccggggctcctggccaggaggacccaccatcagttttcggcacggcttgttccgctcaacaccgtccagaaacttgacatcttcggggaaatgccacggtttgtcacactcctcttctcgaccggtgtagtttcggccaaacgaagcagacagtccatccatgtccacggggtttgtgatgtacacgtattcgtcgtcggtggatcgcagtcgcacaaacaaacgacatgcttcaaggtaggcgtccacagagttctgttgtcgcaaagtgggtagcattttcactagagtggtgtaaaccagctgggctttttgaggctggatcaacataaattggccgaacattcgtcccagagagtacaccagctcaacagcgggggcctctccagtagctgtaatgtctcgtagcatggtgttgaacacgtcgaaggacgcacttttgctcatatcagtaagcagagtcagcaaacgcgatcgaaccttggtagtcagatgtgatgatctgtaggtatttgagagcatggaaatcagcttgttcagcatatctcgatcattgacttcagaagagacagtgtagagtctatccataaagtccagaaccagcatccgtacgccatcgggccagtagggctccaaaaagtcgagaacaagctcagtattggcttcccagttggaagaaaatggcgaacagaggtacgagtcttcgaagtgacgcacaattcgagcagcagaagattcgtttaagaaaggagccatttccaaatagaattggatggtctgttccttaggtgcagtaaagtcagccttacgttccaaagaagaaacaagctccacaaaatccctgatgcacaacatcaacttggatggttccggggcaggagcagcactatcctccttgttctccttgccatccttggtggagtcagcagaaaagatactgcctgctcgcttactaagccgtgatcgggtttcgaaatgtgcgctcttcttgtcaaagagcgaagttgagccctgacctgtacccgcggtcttagtaatcgaacctgttcgatgcatacttgattggttgcctgttgctgaatcatccatttcctgctcagcacacctggcaatgatcacgtaaggtgagtggtccgagtcccagtcttcgtaggtgatttttcggcacgtttcctggtttcgaacgagttccgtcacgttctgacacacctccaaatcgtggttggcgcttcctagacgcaaagagtcctcgtaagctcctagaactgcccccattgtgatatccaacttcaattcaggaggggtattctcagccagcacacgcagaaatcgaacagtgcctctcaaagtgtttccattgggtgcgttttgtccagatgtgttcttgccagcatcctggaggtatctgaacatgatttcaactgttgcatggcccacatgggaactgcacagcatagtcaaagactgtccaacggcctcttccaagtcgggaatggtgacatatgtggagcacagaatgtcgaggaccacgggaatgctcttgatgggcacgtagccgctctgaatgaccgtattgaacatttcaagggccgcttcaatgtctgatttggaagacgttcgacgacacatggtcaccacttcacctaaaattgctccaacctcgtcgtcgttgaacatttgaaagttgtgttgaagcatgctggtcagcagtttcataagggtctgcaggttgtcgttcatggtcacttttcctcctgtagaggcagcggtaacgtcgtcgattcggcctatacgcacgtcctgcgcctcggcagccagacgtttgagccacgagctgagaatgtgtgtgaaggggtatccggactggtacaggtcgaagacgtttttgccattgtcggtaaggactcgcagcacctccagctgcaggtcaaagtcctggaggttggagttctcgatgaggctttgaaagtacgccagtcgcgatcccgtagcgctctcatcctgcttgatgcatgcaatcataagcttgaggccgcttcgtcggcactccgtgggttggtccgtcttggtgagatctctggcggcataccagatttcgggaatcgatgacaccgagtatgtttggactgcatgctccagtgccatggccgcctcgacctttttgtcgggcgttcctgtcgcaagcacgcgcatcagctcctcctggtctgctgctcctcctaccactgtcggccgagtctggggagctccgctggaggacgacttgaagcccttggtcagcgacttgaacaccgagccaagtccgcttttctgggtcactgggttagaaggtgtgattggaagcgagtgtcttcggtccatgtttgtaatagaatggtactgtaccaactgttgctattgtagatatcgcactatggcaggcactagcggactagcacggaaatatgcatagatcacgtgacggtgggtaatagagggcggtccttgattcgccatgccgcctgtcatactcacttgtatctgcgttgctgatgtggtacagtaatgtgctgttggtttgattaggacactcctctcagtctgtcgatataccaaacacccagccgtcagatatgcacggcagtggaaaaaataaggttggtgggggagacgaggcggttgatggcgtggattatggacattgctttaagagaggtttgggggggttgaaatagtgagttaccgtaggaaagttgatcgaagacatgggcttggatttttgacgctatcgcaattatttggcgttttagacggtatttgggctcatgtgaggacatgacgaggtaatttcaagtacgatatttatgcactctaaactacttttgtaagtagctagtagttgaagctattacttgaactcaacttgggaggcgagaacatcgacaggagatacttgatgagtactgtacatagcaatggtttaactgatgtcataataacttcacaacaaactgtccttcttgtaatttccctaaagccatgatattatgataccatacatttgacatggacatcgactacaatacatatggtacagtacatacagtaccgtacttgtagctaccgtattgtacatattgtacttccaggaactttgcatcgaacatgagatcagtttgcacagctcttaacctgtacccttgtcatgtgttttaagaaggtcataggaacaaacgagagctgtctaccgacacccaacacgtctgttataatcacttatgctccgcgatccattctccaagtgattccagcacactgacactcaatcatactaatactgtacgagggagtgtaactcagacacggttatagttgcttgtactggagcggtttgggcagttttcatctgtatgttggagggattagatcggttagatattgggagagcgcattgattgcaactcccttatttgtcatttcaattatgtgacaaaactaatcaaaactggctctgttggtttgatatccacaaccccgttatcacaactttaatcaaacgcaaacacgcttctacacactcacatgtctgaaaagccgactttcacggagggactcgaagaggtggaggagctggggctcacagatctcggctcgctcgcacactggtctgtgtcgtcccataagactgggtgtggcgtggaagcgcttcgatcggacgaccaccaactgttctggcagagtgacggcccccaaccccaccacttggatatccacttctcgaagcgggtctcgatcgaacgggtctcaatctacactgattacgagctcgacgagtcgtacactccttccaagatcaaaattcttgcaggatcagggtaccatgacttgctggaagtgacagaggtggatctggacgaaccccaaggatggacgcatctggtgctggatggactgagagaagatggcgtgctgaaaacatacctgttgcgattgctgattccagctaaccaccaacatggaaaagatacacacttgagagctgtcaaggtatatggacccaggaaacatatggtgatggacgacagtatttttactttcaccacaccacagatgttcagcgaacaggttattcgatagaggatagtgacggaaccggaaccagtcttggtgacatagtcaggatcacggaacatgacagtcgtcccgctcgtcatggcggataagcgtcaaagccttgttgtttgtgctattacgcatcaacagaaccacctctgtcatctcgtgtggggtacattcatcgataccaccggcaccagatcagatgcaattctgtacatcgctctgtgtgcttcaccatctatcttggccaggctagtggcggatgtcactcctgctgtaagattgtgtcattctgcgatatctgttatgctatcacgtcaacacagtgttaccatacagcaatggaaacaagggtgaacgtactgataccctgaacagccgttaggactcaccaaccacaacacactttaaccgcagcctgctgatgtatgatcttctgagtaccagcagatccgccatccttgtcaactccttgtaaatagctaatttatcctcagcatacgaagagctccagaaaatagtactctcggagaggtgtttctttccgaccctatcattacgagatgactgcttataccaccagtatatcctccaccgttgccatgacaacgggcgaagaagtcatgtgcattcgaagtcgagaatgtactggtaccgctgtagatactcatgttgctgagctacagaacgagaaattgtacgaggatgtcacttatatcgaagtttcatgacgttttacggcggccagtcgaatcttctgtcgtcgtcagctacaattgtagtggctgctgtagtagaagttttaggaattgccagatgcaatcttgaacaatctgttgcattgaaatatatatcgatctacaagaaggaacgactcgaagtggcgtgcaaagtggacagtacttatcctctcaacttgaggtcatacaagctgtcgattcctgttctcacagtcctacatcgatgtaggctacttgtaggtgatataaaataaattaatgaataatgtgattataaaaacaaaaaaatggttacattttggaacttgatgaaaaagaggatcaaccggagctagtgaaacgccccctcgtcatataatctgccacaaatactccttacccatgatacatacaaaaacattctctcctcttttccgccatgttcgatcccatttagatctccactgatcaagactgaactgtataattactgtactagagtacttgtagtagcgagagactgttgacccaaaagccaatgttatttgagtccatgaagcagccgtacctgttacaatagtagacgaattcgattcagcttacaacccaggaccatctcccatagtaaactaccgcccatcagccattattatattctacacacacacacataaccctaaccacaatccacaaatcgacacaagtaaacaaactctaccttcgtgcatgcatataagtcctaccacacctttttatgaacaccgccaagtgtgtttttttgcgtctaccatcaccacaccacacaaccacacccatgactgaattcgaaacggtcgtcgcgctgctcaagcagtcgcagctgcctcaatctgcccgatcagccgagcagcagctcaaggagctggaggatcaggcggactttcccattgtcatgttgcatgtcgtggctgcccagaatctggaggaatcaactcgtctggccgctgcgctcttcttcaaaaactttctcaagcgaaagtgggtcaattctgacggccagcatcttctgcagccttccacggtcaaaactgtcaaggatgaggtggttggtctgatgatctcgcttcccgagcgtctccagatccagctgggagagtctgtctccatcattgccgactcagacttcccccacaattgggaggacctggtgtcatcactggtggcccgattgagccccacagacatggtcaccaacaacggcattctgacagtggcccactccatcttcaagaagtggcgaccactcttctcgtcggacgacctgaaccgtgagattctgctggtgctcaaccagttcacagagccctacaagcaactgtgcgaggaggtggatcgccagatcgaggctaacagcaacaacaaagcccagctcgacatccttttccgagtccagttcaacatcttcaagatcttctttgatctcaactgccaggacattcccgccttctttgaagacaatctcgactactttatgaacctgctcaaaaagtacttgtgctacacaaatcctctgctggaggaccccgatgaggacgacgaagctggcattctcgaaaaggtcaaagcctccatttgcgacgccatccagctctactcgctgcgatacgaggagttcttcggcacctaccttaatggctttgtggaaaccgtgtggaacctgctgaccaacacctccacacagcccaagtacgacattctcgtttcgcgagcactcaccttcctgacttccgtcgccaaggtgccccgacacacaaacatgttctcctcccccgaggtgctgaagcagctcattgagaagattgtggtgcccaacatgagtctgcgagagtccgacgaggagttgtttgaggatgatcctctggagtacattcgacgagaccttgagggatccgactccgatactcggcgacgagcagccaccgatttcctgcgagagctcaacgataaggcggagtcttctgtcacaaaggttgctctggagtatgtggagcagttcctcaacctgtacaagcaagaccctgcctctaactggaaggccaaggatactgccattcatctatattcgagtatcgcggcaaagggtgctgtcacctcttctggtgtgacttccatcaacctcactgtcgacattctgtccttcttctccgagaacattgcgcctgatctcatgaacgactccgcaaatcccattctcaaggtcgatgccatcaagtacatctacaccttccgaaaccagctgtctcgagaccacctgatccaagtgttccctgtgctgatgaatcatctgctgtcaaccaattatgtggtttgcacctactctgctgttactgtggaacgactgcttgctaagaacgtgtttgacaagactgaggttgccgagattgcccagcagctgctccctaaactgtttgagctcattgccgcaggaggtacccccgaaaagatctctgagaacgagtatctcatgaagtgcatcatgcgaatcctgcttgtagctggatccgacgtggctaccggcgatgcaggcaagcaactgctccagcagctcattggcattctgcaggagatttgtaagaacccctccaacccccgattcaaccattacacctttgagtccattggagtgcttcttaagtacaccgttcccgtagttggctttgcagctgtccaggatatcgtttctcccaccttcctgaccattctggagcaggacatcgccgagttctcgccctacgtgttccagctgctagcgctgattctggaactgtctccttccatcgactctctgccccctgccttccaacaattggctcgaactttggttgtggctcagctgtgggagtctcgaggaaacgttcctgctctggcgcgtctcctgaaggcaatcatctccaagaacggctctatttatgaggaaaacttgcttgctctgttgggtgttttccagaaactcatctcgtcacgggtcaacgacgagtttggcttcgaccttctccaagccatcatgctgcacatttccccccaggttttgcaaccccatcttaaggatattgctgtcattctgctgatgcgactgcagggttctcgaaccgaaaaatttgtgaaccggttcgcctactttgtggtcttccttgctgccactgctcccactccctctttccctatcacctttattgatcaggctgagaagggcgtgtttggcacaatctggggccaatttttggtcaacgctgttcccaacgttcagggtcctcttcagcgaaagaccgccgccatcggttgcaccaagctgctgactggcacacctgagttcctcggaggcgaatactcgtctctgtggcccaccactctggagaagctggtgcagctgctcaactctgagatctccaagagcaccgaggaggtttctccggaggttgatctggactcgctgtcattcggctcttctttcaacaagctgtctacatgcacccccaagcctactgatcctctgcctgatattcgggatgccaagcagttcttcgttcagcagttgcaggccgccaacaaccagactaacggccaggtgaaccagctgattggaaacagcagtgaggctgttaagactgctctgcgagactttggatatgcttaaccaggccgtctacttcctcgttgtcatatagtaatcatgtcactatagagacatgtataataaatacccctcttggctatcaaccaagactttcgttatgtgatgaatacttcggtatcggaactagtttacagtttgtagaagcatgtgtcgccttaaagaccgtctcttatcctccggtcgatctcgaacagcactgctataagattctgagtcacttgatccactgacacactggaagagctgcttagttaaatcaagtggtggaaacctaggtctttgagctttgggcgttcttgtcatcataggctgtccactcgaacgaggaacatttctcttagtacaactgtattgtactggaaaaatccacacggttaggccgtggttcatggtatatgaaacctgtaaagccgtccaaagagtggtattcatctgattctgaattgttgttggcttgatatctaggtgtccggtcaaatttgacttccaacacttcagcaaatatgacatccagttcatcttcttcaggtccccactgtcaatatttcctacagtaatgaagaaatggcttcctgtgattggtcctgtgtcataatataaggagtaggcagaggcttagatgtgagtttctccttcagtagtcttctttcaataggaagcagagtcgaaatgatgaaaacacctgggatcttggcacgtttgccgttgtctttttgttctcttgagtgtatctgactagcattgaatgtaggaggtgtcttcatgtcggagctgttgtttcagtctgtctgacaccctcaagagaccaatctcgtacagtatgtacatactgtagtatacaaatctgtcataggcctccttgagactcatctcagcactgacagcaagtggggcaggagttttcgccataggaactgctctaggatcatccttccagtagtcaatcagactaacgacgtatttgtggtaatcacttcttcggcttttcttcaattgcccccaggttttgtctggggcaatgcttgccgaagacctgtttgggaattgtagaacatgacgcccgacttcgctcggttgaagtagagcatttagttccctttattgcatcccttcatctttttgaaccccctcaagaccaccacattgccaactttgagaagtggattcggaggccattggtccgagaagtggacgacgaccacggcttccatacctgacagttgacgagacccaaagtcggtcaaggtgaagagcataccatcaccgacgacaaatatacgcgcaataatgaggtctgtgaaggatgttcccacactagggaaacatcttcaccggagtccaatctggaggtgacatggtgataagaacgagtagcttggaacgcgtctagaagcgttccgatgaggatgattagtgataaacacgtggggaggtaccgtgatatttggggccgagaatagaaaccaaaatccttcaatgaaacccgaatactcgataactcagagtacaatcaatggcgactgtcgcgtggttgagagtgaagtgcatgggagctgtgggctctatgcagtaagaatttccacatccaggttcgataaggaggcgtgagaaaggaatatatttgggtgttttgtgacaggagacgatggttaaagaagtgagactatagttcgcaaccatataaatcgatggtgacgatttgatgtctaccaatctgcgtttgattcggcgttgtgtcatctcgaatttactcgaccttagttgagttgacgaagtattgttagcagttattgttaagacttcacgcgattcacaacacgacattctgttgtggacagcaacgtcttaatatacagcagtgtatgaaaaactctcctattacaacatacagtacatactatgcctctttctacgaatctcaatgcttccgttgctcgctctatgagcagtactgtactcaatatgttaatctatctggttgtgacgccattacatcactgtgttcgtttgctcgtctattgaacgagctgtgcgttttgtgagcccatatttctaatttcttaggaggcaattcgtgccgggcttctcgtaccatccgccttcaatcaggtcagtctctagagaggcccagtagtctcgcttctcagaaacagacttgagatcagcatcgacaatctttccattaacagagtcgccctgaacgtgcacaaatagtgacacgtctcgcatggtcatagctgtgacaaactgaggaggcacctggacgtaatttgcgtaacccagaatacccaactcgtctccatgctgcatgtgtctgatctcggcgaacagctctgaattcgagaagaacttggcaagaggctcgaactgcttttgtgtgccggggaacacgtcctctagagcttgcagcgatgtctgttcgtcttcgttgaaaagcttgagagggcagattcgaggcttctctcgcttgagctgtaacgcgcaggttcggcagttgatgctgtccttgggtgctgttgggctctgaagcagccacttgggcttcaattcgaccgtatatgactcccagttgtcgctgtagttgattttgactgcgtgggacttgagcacgttggtttcatttggtttaggccccaggttctccatgagcagacccaggggctctccgagatcgagattctcggcctcgggaagcgactcgaggaaccccagaggcagattcacaactgtatagtgaaacagaaaggggccaatggccggtcggattgttccagttagatactcgtccacctcggctgtggaaggggcgtttcggtttcgtcgcagtcgcagaagcagatcggtctcatcgctcttgtaaaccacgttggcgttacctgccgttaacagggtccatttgtagggaggcagcggtgtcggtagcgaagacatgatggtagttgaatcatgagagtggatttctgaacgctatagagttgtatatgagggatctggttaaggttgatagagaagagccagaagtttaacacgtgttgggggagagaaggggtgacgaaaaaaggggtggggaagggaggttttggtggcgtgaaaaatggaatcaatataagtcgagatttggaattaaatgcatattttagaattgttatacgaatcccataaccccccactaccgtgacccctctagtacagtattattcacagttgacgtgtacatgcacaagtacaatcaagtactccatgcattgtcaaaactataaataaatgtataatgaaaaacatgttcgagtttggaagcagtcgggtgcaacgatgactaatttgtgttgtttggggcagttctagtagcagaagtgcctgtaatctgtttcgcttcccccacaagtatctatgattgtccccttactctgtttttggcccctatttgccactctccagacctttgacaaactcacatgtacaatgatgtcaacctaacgacgtctgggctttacatctgatacatttcatttgaataatgagagttttaaaagttttagacaatcagtgaaaaaataaacgagtaaaactttcgggagaaacgcctctggatgattttggaacccatctggcgagcttttaacagcgtggaaatacggtcggatcgtctcacgtgataaacgatagagatgcatggaagtgtccgcgtactatagttcaagttatggctatagtgcaagcttaggatgacaagaactccagaaatgggctgaactcaatagaagcataaaaccgtttcgaggactggcctgcgtttgattgtatcagaacaagccgcagattattccagggatgagaagaagaggtatcagaagagctacaagacaaggacagctcgagtagaatcaggtgatcaggggctttctgctagtaccctaaataatgtacttcttctcatgaggggatgttggtaagtaaatgatattgcttgaggataactgataccgaatgagtacagcagtctagtagtgaaggagttatggaactcttctatattttttacaatagctgtacacaagtactatttacttgtacttgtaattacagtgatctagatcacaaaacggcaccctcctttaaatgtgatgtttgcgggaattgaacctaggatgttataacattcggttaagtaattaattaacttaaggtcaacgagtcatcggccattactttaggaactatttcctctccaacaccatgatttgatatcagtccgaagttttgaaaagattttatggcattataacaccctcttttataatccacatactttttttttacaattactagtcagaattgccacaataatcaggctcctctaatggccacctatctactactaaaccttaatccttgccaaccttacccaccaacatcaccattgccacccacactgcacaatcaatcacacgacatcacaattgcgacaatggaaatagacaacgacgtgcccactatcctggctactctccgaatggaggccgatcccgagctggccgcaactttctactcgttggaagatctgtgggagcgaaagctgtggcaccagctgacagatgcgctggccgagctgtacgcagacccccgatccaagcctctgcgactgcgaatcttcacgcaattcatccaggtttttgagcgcaacttgaaccagctgaaactggtcattttcggagtgctggcagctgcccagtgcaataacgacgaggagaccttgggcttcctcaccagcctcgcagataaggtcagccacaagcccgacacccaggatgcgtacgtgtacgcccagattgagattgcacgagtcaagctgcgtctcaaggacatggatggcgctcgagaggtgctcaactccgtcaccggcaccatcgactctctgaactctgtcgatcccatcattaccgccgcctactacggcgtcaacgccgactactatctttccaagggcgacttcaacacctactaccgtaacgctctattgtacctggcgtgcatcgatctgtctactttgtcggtggaggccgtccagaagcgagcccatgaactgtctgtggcagccctgttgggagagaagattcacaactttggagagctgttgctgcatcccgtactggacagtctgaagaacacagagtacgcttggttgcgagacctgctgttcgcactgaaccagggcgacatctccgagtttgagaagctcacatcgcagcatgtttccaagctgcctcctctcgaggccgccatgcctctgctgcgacaaaagatctgtctgacagcactgacagaggctgcctttaagcgacccaccaacgaccgaactctgacctttgccgcagtggcaaaggagactcagctgcccgcagacgagattgagcatctggtcatgaaggcgctgtcgttggagctcatcaagggccacattgaccaggttgctcagaccatcactatcacatggctgcagccccgagtgctcaacaagcagcagattgccgacatgaagcagagactcgaccagtgggacgccaacgtcaagcagttgggtggatggattcacgaccgaggtgagggtgtttggctggaggcttaggcacaggtgacttatagcatgtatgaatagatgtatgatcatgacacgtgtaatcagcggagtatctgcctggtgggctctactatctctagcagctacaatgtagtatctcctgcgtgtggcggtcactctataataccaatataatgattcgatcaataataaatatacataaataatctactcgacggacttgtcgctctgagcggggtccgtctggttcatctttgttagctgaggaactccctcaacctccataccctcgagctccaagttgctctgaggtccttcaaaccacttgtgggcccatccaaagtagtagatgagcgagccagcccacacggccacgttaatgacacaggtgtagttcatgttgtccttgttggggttgggtccctccagagggaacatcagcagacagatggcaaaacacaggtaaagcacagcaaaagtcgaaacacacttggagatcacacgaccaaggtagaagggtccaggcacgaagttcttgtaaccccagatgagtctgcaggcgataggagtcatccatgccaggtcgttagaagcagcagccagagagaagagggcagcagcagcggctgcgtcgatcatacagagacatccaatgaccagcccgagtgtgcagttgccccagacggctcgcacggggattgagaccttgtggttgacgaccttgaagaagttggagaaaggaagggctccgtctcgagcaaaggcccacgactgtcgcgaggctgccacaacgatagacagccccatggtccactggagcacgaagatgatgaccatgagagcgagggtccacttctttccgagacagtcgtaaattagctgtgccatcggctgctggaagggggtagagaggattcgttcagtgtcgggagccatcacgcaagccagaacgatgttgatgacgaatccgagaacccagcacattccaatcgaagagatgataccgaagggcacggctttggttgcgttggaggcctcctcggccatgtggacacacgagtcgaacgaaccaatagtccagatcggggctagccagcccaggaagaaagtccatccagtaggccaggtggtgaggttttcgagcttgccgaaaatgtaggctccgtcatgtaggttgtgtcgtgcaccaataggcagagcaatgatggcaatgataatgatggcaatgttaagaacaatgcagccagtctggagtttggacattccatcagacgcaagagacgcaacgatagcgtgagaaatgatgcaggcagcaaacacgccgtaaaccgtgtactttgttgcgacgtattctccatccgtagctactcctgccacagctagtaccagctgggcgaatccgtagtcgatactgacaataccagctgtcagaccgagagtgttggagtaaccgaccagaaaacacaagggacgcttgagctttggggtagcaaagtggtaggtccaccagtagagtcctccagatgtgggcaatgaggagccaagttcggccatagacagcccgaccatcatgatgcaaaaagaagccacaaaccagccccacaccatccctgctggtcctgagggcatggaatagaccagagccgaggaaatggagggaaacaaacccatgatactgaaagcgatgccaaaaacttggatcatagagtagtttcgtttgagctcgggcttgtaacccatcgtggccagcacgttggcgtctccactgggagggttttgtccatatccttcttcgattttgtcgtccattagaatgatgctaggagtctatgagaccggcggacgccccagggcatatataaaccgatccgggggcgtttccaattgcccgggactgtttaacttcggtcgatatcggctactggtcgggtatgatagcgtttgttctttgtatctccagaacctacacaccctggttagcaactgtatgtgacccgaggggaatgtggggtatgcgtgtgacgtgtttcgtgaagtacaataccattgtgatgatttgttgtttccttgtttgtatatgtggtggtaggccctgttagttatgttgacaatatcgtctttttcccacttgtcataaagtcgatctatggtgcatactttttttcatatcttgtttgccaaggcttggcgactgactttcagactgttatcatatcaggcgagctcagacgcagtagacttcgtggggtaatatggaaacggcattttttgacgccgggccccttgatagagtgcgcgtgagccaataacgtgcctttgttgctgtgtcgaaggcgtgatccaaacacaatgctaagcatagttcaactttgataagcccggtggtttttgcgaggtgagtttgggatttgaggtggtctgagaacaccgatttttttattgtagagtatataaatgtgactgcttctattggacgtcactttattacgtcttttacaccttgctatctgcttcaaatgacgtcttcgttggctgttcgtatgcgaccaactcgagatgaggtcaggtgtgcttactcccagccctgcaagcttatttcagctctgatcgagagacaccaagacactttcacttgaaggaagaatttgtcagcagttgtgtgtattcgtaccaggggcacatcagttacgagtgtgcaagaatgacgctgtgagaagaagagtgtctcaagtgtgacgtgcagggcaagatctcaccattacaagtgcgttcctgaaacaccgatccaaaaaaactgagatacaatgttgtatctattcgcatacactttaaacgtcagcgtcttatctacagtatatgaactctcgcataatagacgttaatgatccaaataaaacaaatgtctatcatagttgaggtctgtgactggccatctaagaacagatggaggaattagcacgcataaggtgatacctagtagtactaaactgtaggagttacggttccgacagcaagtcgagatacgacatacaacgtcatctcttcttcaacactccagtctaaccaacacaccaggcccaccatcgatcttacatgtacagtagtacatacagtagctcccttgttggcggctagacaagtccttgtcaaaacgccttaaacccagactcccgaacccaggcagaagacatacatcacaaaaaagataccacaagaacgcagtaaaaaaggtcgtacccggaatcgaaccggggttactggaaatcgaagtaggtgcttcagaatccaaggtgataaccgctacactatacaacctggatttgagtttttgaaaaacgtggtctccactctgttacatctgcttagtaatccactgcattagaataaaaaaatgcatgtttttgccacggaagcctttggggtgcctttataaatgtatatctaggtgttgggagtagcacgaagtacttgattaaacacgtatgcaagttttatgtgtcgctgagttattcaagaggtattgtgattgatgaaacagttccgctacagcactatgcataatgcaggcttatataatcaatatttattggtccatcgaacgtctgaattaactgttgagcatctctgttcttctgagtggcttgtgtcagtttcatttatgttatgttggtatcccatgagtacatactgtagttaggcttgaaagagtagagacacgttaacttggccaaatacttttatcccatctttatgatataataaatccaagtgttccttgtcacttcccttatatacatagtcttcaggggagtactggtgctggtacggtttccacctcgtgttttgaagatcgagggtaaaacgaacaagtaaaaagacgttagatgttaatccgaggagacttgagattcgtgcaagtctcgctcgttatttcagattttgtttctatggtggtggtcttctacaagtagccttgtgcctgtcacgcggcatttcggcgatatccgatttgagaatcgttcaatgaaaaggaggcgtgtgtacaggtatgtgaactttttatttcaggctttaagggcgctgtagaagtctgttctgatctagagaagctgattgttgtatctggcggggtcgcttcagtgtcttgatacacccgagacaacgtgaagtatgtacatacaagtacaagtaagagatttaaagggagggggggagtgtatcgtacttgtatttaaacaagtacccttgtacttgcaccaattgggtccttttcagagtcgggttcaaaattttcgcgaacttgttcacttgtgactccttccaacctgtcctggcgtacttgtagttgtatgagtatactctgccaattcccagtgtgcaagatggaggactaaaacggtcgcaagggacaaagaaaagcttgataaagcgacaaaacacaaagaagctattattcatcagattgaattccaaccctcagtgtcccggtcttgagtctcgtttcaggtggccatcggccttctccgaaacctacctaggggtgggttcattggtgaaatatgagagtggggttcggtaggcatgacggtatatgacccaacaaaacctatatacccaggtgttctcgtttgacaacaataaactgttctgagaccatactgctacaagtacacacatctagactttcagtcaatatacatagagccaatataaggttcccggtaatcagatcgcgagatgagaactcagagacatctcaactgctgagggacccaacaacccggtccacttgatggtttctaccacaaaaagattgacttgttctacctacagtactgtactgaaatattgcagcaacttgcaccaaatccgatcgcgcagtgcacattttgctgctgcaccaattgtccgaacatacggcccgttggactggcacgcggactcagcagctaatgctttggaaaagctgagtgggccgctgggccgctgtggaaatggaagtttaccgtacaggacgatgcagaatcatgcatcgtgccactagtttgccacactcttgcgcatgctgattgttgcgccttccgttctcccccgtctgtgattggtacgaaccctgatctgatcagagttccgacttcggggtatgagatggtgtttgtagatgaggggatgacgaatgaggagcgacaacggaagtgtgagcaacaagataaacgggcccagcagaaaccacatatgcatcgcttctcaattattgctacaaaaatgcacatttgaaatgcaccctgtgacccaccatgtatatgtttggtgtaattagtctacatgttctgcaacagaagttgcaacggcccgttgggctccgacggattaaaaaaaagaccctacaggtgtttgcaggagtagcgaatgtgactgttgaagtggtgtagtacgaaatggctactgttgtcgggttatcagccaaagacgccctggcaaactgcgtctatcttcttacaatcagctctcttgtcttcctttcccctcctctatctcatcttcttcctgctgcgtctttggagtgagattgtgcggtccgaagctcactgtcctacgatacaaggttgaggcgcaggtggagatacgactgaaccagtatcagtgtgtggaatgaggatggaaccggcacgaaatagaaggatctggaggccatgattggattgttgatcagtggacctagtatttcccaccaatccctggatacacttgtaaatacccacccactcaccgcacttactgtaccacattaactcccgcattagcacccagttcaaaaaaaactagaatgcatggatgtgatctgatcggaggaaacaaaatgagctgtattcaactatagttgcaattcagctcgcagtacgaagtagcacagatcgcttccgtgtactgtcattctatggactccattctctaccctcaatgtccatctctccacacctcgcatccacctatctcttcatttcgtcaccaccggaaaagccgactttggtctccttgaccagtgtatacagacagagatggcccttgttacccagagataagactaggaccaggagctcccattggcttaaccctaaatacggtttcattaatttttcacacacaaaggcgctccatacctgcaatcacggcttatcgcagagtctaatacgtgacacccggcctacgggcgccacgggctcctgaccggccaactcagctatcatccattagagttgcgatgatacgagtatatagagacgcgtggccgcaccaagaggacaactaaagtcatacaaactacacctaatcaatatcacaatgtgcaaatcaatcggctggactattgccgaatggaaggaggcacagaccaactcgtcttacgaggaggcccgacatcgactgttggacctcgtggccaccttcaaggactacaagcatggtgatccggcttggatcactgtcgcctcaacagagcatatcaacaagcaatggaaggagcttcagttgatgaagaagaacccagaggtgagtaaagaagataacgtgcaaagtgtgtcagcaaagtgaggctcagaatacaatcaacaggatgattcgttgcaagactcgataatcaaatcatgatctgcttgagtgatctgatccatcaattggaattcagatcagttcagatcagttcagatcagatcaggatcattgagttggttggaagaaaccatgcgagtaccaatagccattccctttccaacacgccactcagtttacgttcttgaactaacccagtcccttcccctttacggagttcctttcgctgtaaaggacaacattgatgtcatcgactttcccacaaccgctgcatgccccgcctatctctacatccccaaggaagacgccaccatggtccgtctgatcaaagaggctggaggtatcgttgtcggcaaaaccaacctcgatcagttcgctactggtctggtcggaacccgatctccttacggaaagactcccaacaccttctccgacaagcacgtatctggaggttcgtctgctggctctgcttccgtagtcgcccgaggcctggttcccttttctcttggaacagatactgcaggctcaggtcgggttcccgcctctctcaacaacctggtaggcctaaagccaaccgttggcgcattttcagccaagggtgtggtacccgcctgcaagtcgcttgattgcgtctccattttctcgctggtcctgtctgacgctcagctggtgttcaacattgccgcccactttgacaaggacgattgctactcgcgacgtttcccccagcgacctctcaagtcgtttggccccactccagtatttgccgtccccgaaacccctctgtggtttggagatgagctcaaccctgctctcttcgacgacgccgttgagcgtttgcgacaacagggcgtaaaggtcgtcaagattgacttcactcctctgttcgacctcgccaagtgcctctacgaaggtccctgggtggctgagcgatacgctgccatcaaggactttgtgcagaaccgaaaggaagacatggacgaaactgtgtatggcattgtcaagcaggctgagaacttcactgctgcagacgcctttgcctacgagtacaaacgacgagccattgtgcgaaagattgaggagatcttctcttccattgacggtctgatcgtgcccacatgtcctctattccccaccatggagtctgtggctaaggagcctgtcactgtcaatgcccaccagggtacctacaccaactttgtcaacctcgctgatctctctgctctagctatccctgtcggattccgaaaggacggtttcccctttggaatcactctcatctctcaaaagttcaacgactacgctctgctggacatggctcagaagttcctgcctgcttctcgacctctgggtgctctgccaaaggacaagttcaccgccaagaagggagatcttcttgcctcttctatcgtcgacaacatgcctcgaaccatccctctggctgttgtaggagcccatctcaccggcatgcctctcaactggcagcttcaaaaggtcgaggctactcttgcccgacgaaccaaaactgccgactactaccgactctacgctctggcgaacaccgtgcctacaaagcctggtctccgacgggttcttccctctgacactactctccgaggcgaggctattgaggttgaaatctgggacgtgccttacagaaactttggagagttcgtatcaatggtccctcatcctcttggtatcggaaccattgagcttgccgacggaaaatgggtcaagggtttcatttgcgagcagctgggatacgacgacgctgaggacatcaccaagtttggcggctggagagcgtacaaggctgagactacccagaacctggagtccaagcctttcgagactgttctggtcgccaaccgaggtgagattgccgttcgactcatcaaaactcttcgaaagatggatattcgagctgtggctgtcttctccgagcctgatcggttcgctcaacatgttcttgatgctgatgactctgtgtctctggaaggtaccactgccgccgagacttacttgtccatccccaagattatcgctgcttgcaagaagactggagcccaagccattcttcctggctacggtttcctgtctgagaatgctgacttctccgacgcctgtgccgaggctggtatcgtattcattggccccactggtgactccattcgaaagctcggtctcaagcactctgcacgagagattgctcttgcttctgacgtgcctcttgtgcccggtacaggcctgatcgagactgtttccgaggcctccgaggctgccgagaagctcgagtaccccctgatgatcaagagtaccgctggtggaggtggtattggtcttcagaaggtcgacaaacccgaggatctcaagcgggcttttgagaccgtcaagcaccaaggtaagtctttctttggagacgatggtgtcttcatggagcgatttgtcgagaatgctcgacacgtggaggttcagattcttggtgacggcaagggcaacgctctcgctattggcgagcgagactgttctcttcagcgacgaaaccagaaggtcgtcgaagagactcctgcccccaacttccctgctgagactcgaactcgaatgatgaaggcgtccgaaatgctggcaaagaacctcaactatcgaggtgccggcactgtggagttcattttcgatgagaagcgaaacgagttctacttccttgaggttaacgctcgtctgcaggtcgagcatcccatcactgagtccgtcactggactggatcttgtcgagtggatgattctcattggagctggcaaggccccagacttcgaggcccagcgtgccaagaccccccagggtgcttctatcgaggcccgtctgtacgccgagaaccccgtcaaggactttgtgccttctcccggtcagctcaccgacgtgcagttccctagtgatgctcgagtcgacacctgggtcagccgtggaaccaagatctcagcagagtacgatcccactcttgccaagattattgttcacggctctgaccgagctgacgccctgcgaaagctccagagagctctggacgagacagtggttgccggcgtgaccaccaacctggactaccttaagtccattgtcggatctcagatgtttgccgaggccaaggtgtccacccgagtactggactcttacaactacactcccaatgccattgagatcacttcccccggctcctacaccactattcaggattaccccggtcgaaccaagctgtggcatattggtgttcctccttctggacccatggatgcctacgccttccgggtggccaaccagattgtgggcaaccaccccaaggctcctgctatcgaagctacacttgtgggcccctcaattatgttccacagcgacactgtgattgccatcaccggtggatctgctgaggccactcttaatggtgagcccatcgagttctggaagcctgtgactgtcaaggctggccagactctcgcaactggccgtctcacttctggctgcagattgtacattgcgattcgaaacggtctgtctattccagagtaccttggttctcgatccaccttcgctctcggtaaccttggaggcttcaacggtcgaactctcaagtttggcgatgtcattttcatgggcgagcccgagcttccctcctgctccattcctgctcccatctccgagcatgctcctgcctctgatgacatgatccccaagtatggcaacgcctggactgttggagtcacttgcggccctcacggctcgccagacttttttgctcacggctggatggataccttcttcgatgccaagtggaagatccattacaactccaaccgatttggtgttcgtctgattggccccaagcccgagtgggctcgaaaggatggaggagaggctggtctgcatccttccaaccagcacgactatgtctactctctgggtgccatcaatttcaccggtgatgagcctgtcattctgacctgcgatggtccttctctcggtggctttgtctgtgctgctgttgttgtagaggccgagctgtggaagattggccaggtcaagcccggagacactgtgcagtttgtgcccatgactattgactctgctcgacagctcaagaaggcccaggacagaaccattaccaacctgtgcggttccccgtacgagtctgttgatgctcttctcgctctggaggattacgagaaccccatcatctacaccgtccctgcctctacctccactcctcgagtcgtctaccgacaggctggagaccgatacattctggtcgagtacggtgacaacaacatggacattaacctgtcctatcgaatccatcggctcattgaggaagctcagcagtctatcaagggcattgtcgaaatgtctcgaggtgttcgttctgtgctgatcgagttccatccttctgcctctcgatccactctcatgcaggctttggtcgactttgagaagcgacttcagtttgtcgagacctggcaggttccctctcgaattattcgactgccgatgtgctttgaggactccaagaccctggacgctgtcaaacggtaccaggagaccattcggtcaaaggctccctggcttcccaacaacgtcgacttcattcgagacgtcaacaagttctccgaccgatctcaggtccgagacattgtctacactgcccgattcctggttctgggtcttggagacgtgttccttggtgctccttgcgcggtacctcttgatccccgacacagactgcttggaacaaagtacaatccctctcgaacctacactcccaacggcactgtcggaattggaggaatgtacatgtgtatctacaccatggaatctcctggaggctaccagttggttggtcgaactatccccatctgggacaagctgtctctcggccaggaccgaccttggctgctgtcacccttcgaccagattgagtactaccccgtcgacgaggaggagctcaaccacattaccaccgaggtggagaacggtcgatatgctgtggagatggagcagtccgtctttgattatggcaagtattctgcctggctcaaggacaactctaagtccattgaggctcacattgcttctcaggcagagggtctggacgacttcgccaacctgatcaaggtcgccaacgaggatctggcctctggaaagactggagccaccaaggaggagactcctctgtcggcctctgccgtccaggtcttctccgaggtcactggccgtttctggaagggcctggttgccgtcggagatactgttgacaagggccagggtatcgttgtggtggaggccatgaagaccgagatggtcgtcaacgcccctgttgctggaaaggttgtcaagttgtacaacaccaatggagatatggtggatactggagattgtgtggctgtcatcgagcccattgtttaattattacttaatgcattatatgtatttgattttgtgacatagactgtagttgttagtatggtatagatttagaaaggtgtatcggtactgtacatactttacagtacaagtaaagtactgtacgaagtggatatcggtaagtggctgcttctcgtggtatcactcgtcattggtatctcatccccgcatatctccttttggtggcaatagccacgtccttccacaaatgggaaagctcatcggcatccatatcccaggaatcatcaatgccatcttcatcaggtgacaggaattccacaagacaaccagcggcaaaagctctcatcacgctatttcgagcctcaaagctcttcttccacaaagaaactgcctggtcgaaatcctcgggagggttgggcttgaaccactgggacgcaagatgtaccagctcagggaggcagcacatctgagcaaagacaacgagctcacaggcatccacaaaagtcatgtcgagctcctcgccgtatatataccgcaccaacacctccaatgtagacgtgggaatgtccactcgcacctcgttgggcaccgcctccatcttcttccatttgagcaaggtctcaaagtatgaagagataccaatgagaacagacgagtggattttgacggcatttccctcgttgctaatcatggtaatgtcaccctcggatgcatatctgattcttgcaaggcctgtccgatgcacttcggtgaaacttggcttgtggtcagcattgagcagattcaacagcttgcttttggaccccacctcgaaccgatggtaagtgctcatctgccagcagtcgtcgaggctgaccaagtagtggttcagttcgtatccgttctcgctgtcgtttctgaacagaaacgtgttctggtcaagagcgacgcatgccgggtgtgcaccatgtttgaccttgtagtttaaagggcagctgatgtgtttgacaccttccttttcgttatagtaaaccaggtagggttttctgaagccatcgcccaactcttggccaaaaatgaaatggaatgttccgactttgtccagagtgcacgaggtgatatgtctttctttgacttccttgtcaaaatcgacctttgtgcatccgagttgcgcacccccgattcgcctgattcgcttgtattggtagttcatattatggcagatgcagtgtcgtggatgaaaggtggagtgaaagaatgcaccaacaaacaatgtggaacaagtaaactattggtagaggtatgtcacggtatttaactaaaattggcaacacatgcatcatgttgccatgtgacaccaaatgaggcgagagcagtaaaatgtctctaaacaatttgaacacacactacttgtagctagctactacaagtatgtattgtatctacactacagtattgtcctctacgccaaatgggaattcaaaaatcttttcatttacacgcccaatgatgcaatcagtctgaccttctacagcttggacttctctttcttcttctcactagccatccatccgaactccaatttttggtccttgccactttcgatgatcacattgatcacacacactcggttgctctgaacagcactcttggtggcaacttccagctcctcaatgttcttgacaaagtagcccttggcacccagactctcggccagaacgtcataccgagtatccagactgagagcagtggaggggagaggctggccgtcagtgtaacgagcagggtcgactccgtgatagataccggagttgttcatgacgtaaatcaccatgggaaggttgtcccgaacagcagtctcaacttcaatggccgaaaagccgaaagcagagtctccctccacagcaaccaccagcgacttggggtcgtaagccttggcagcaatggcataaccaagaccaacacccatagtagcgttggttccggcatccagacgggttcgaggctcaacgtgaccaaacacagatcgactgttatccatggtgttggctccctcagacacaatgaccagctttcggtccttagcaatctcggcaatggtcttttggatgctggcaaacacaccaaagtacttgagaggaacggagtggtcagcctccttcttggtggcattctgcacgtttttctctcgcttggcagcaatctcaggagccagagcgggggatttccagcccttgaggacatcttcgagctgaccaatgaccagagaggcatctcccaggatacccagctctgcctgcccggcattgtttccaagctcctcggcacaaacgtcaatgtggatgaactttgtgttctcgctgtacttgggagcgtctccgtaatgtaggatccagttgagacgagttccaacaagaataaccacatcagcattcttgagagcctgagatcgacaagcagacatgttgcccgggttgctgtcgctaatcacacccttgcccatgggtgtaggtaggaattgaatgttggtgctctcctggaagcgtctgatggtaggctcagccttagcataagcagctccctttccaatgactagcagagggaatttggaggctcgaataagagcagcagcctcagcgatcttagcagggtctcctgccgatcgaggagcaggcacgttgcggagtcgttgcagtactccaaagctcacctggtcattgtccttagactgaatgatatttgctggcaaatcaacgtaagttgcaccaggacgtccaaagtaggccgttcggtacgctttttccaggaggaagggcagagcgtcggtcgaagaaggtcgggcagcaaactttgtgtattcggtgacagcagccacttgatccagttcctgaaagccgcccttgtgagtgttatggacatccacacttccagccagaagcagcagagggaagcagttcgattgggcattgccaacgccggccaaagcgtgcagaactccaggtcctccaactgtaagacacacgccaggcttgccagacaggtagccatagatggaggctgcgtaggaggcactctgttcgtttcggaaaccgatgaacttgatgccccgagcaatgcaggcgtcagcaacctcaatgacggggattcccacgattccaaagatgtgttcaacgcccagttgcaccagtgattccgcgataacttgcgagccgttcattgtgtgttgattgattcggttgtgagacttgcttgtgttgtttgcgtgcgttagtgccgtcaaattatgtgtccgcgtcgttggaacttgtgttgaatgtcagtgtcttgttataagcaactcgttagccactggtggtgtgatgaactatccgagtataagtaacgactcctatgcacccccacgcccccacaccagatgatgcggatgtattaaagttctgtgggggataagagccatccaaggatgtggccattgagcacagtggaaggaggtttgttcggcgattgaatacgaatcaatagatttgacatctgtgaatcgattaaatctttcagagaaaaactctgacatctatagcaagagttgttgaagaaagggcatcagaaatgcgccggacatgtcatggtagcatggacatttgatttgaaggtctataaaatagtacacagggtatatgtaccagtatctaacatttccgaaagattttagccgaatcggagtgaaacccgctcgtaattcacactcttatcgtattccgatacacttggcacatttttgagttttccgaggtgtgatcttgtagagttggttagaagacctcccacaactgaacttgttctgtggtatctataactgtatatataactgctttaatcaactcgtttctgttaccgaaccgctcccttgcacccagaatacggctacagactcgggaataatgtccaacagatcacgaacacgcctgtggcttgctgctaaggaatcttgacttgagtgtggcttgtaggaggaaagttttgataccattgagtgagtcatggagtatcgcggccaaggttgaagtagtggccacccgaagccgttatgaagcttgtctttagtcttccatgtatttatagatatcagacgtgtcatctcactcacggtgggtctacggtacttgcaccaatacaaacctgcaatggtcgtcatgcatcttgctttttcaaagaacgtctccacagtacatactgtactgtacggcatgtacgagtatagtgtacatactggtacttgtagcaactaccgcttgtgggatcagtaggatcaaacgcgtgctgctactggtagatgtttttatcgcctccattgcatgtatttgagaatgtcaatcttgcgttcgggaagctttggcgagattcttgactatctcagaagtccttcagagtatcaactaatttctaaactacagaatgagtacagtaaccccatgatacttacaaacccaactactgtaccgtaaatgtttgtaagttattatataaaaaaagtacagcaaaaagtaccccaaatctaaacagaagtcaattcatggggatatttaggatccagaaagtcaacttctgcaactttttaaaacattctatagcatctgactctccaatcatcatacacgtctcctccccaactcatcgcctctcaatatcgtgaactctaagttgtcccaccaccttcaaacatcaccaactcactaacatcaactacagtactaccaaccacaattccatcgacacaatgaaacaccaaatacgcccattgctggcattactgctagctctgacactctatacaactctggccctcgcaaatacagcgcaggtacggtttgtccctgaattgtcgcgctcaccattctcagacgcgtactcaaaggcgttgagtcctaacgagaacactctgactgtgattacaacccccgactttgagtctcagacgcaaacattccaattgaacggcttgtctaccgatggcaccatgtacgaggttagggtgtgttggcctgcaaattaccccctggaattcgacctgaaattcgactccaagacgaactctgtgaaggtggcgtatttttctgattactatagtagtgacgacgatctcaactacctgcctcttgatgccgagttccaagttgtgctcaacaaggttgttcttggagctcttcctgaggatatttttggagctgtcattctggcggtcgttggaggagggttggcttattttctgggtggagtcgtttacaaggttgtttttgacagccatgtgactactgaaaagaagaacagatagggctgaggagagactgtatcacggtctgccatctttcacggcggtgggtgacatccaacatgattccagcctcttgcagacttctgaggccacttcctgaaatgttccttatgggaaagatcctatgaaggtcgcaaaccacacttggtccgaaaatggccggccatgcagcattcaaagctgcattgcccactccaacaacatagaatcacagaacacatgacattgagatacaacgggctgtgcatacgatgagtagatcgcggtcattacagggcttttaattggtcttttgggttatggtgtctgtccttctcatcgcatctcgaccacgatataagaattgtcgtacagtatctattataccttgaagtttgttgacccttccgatcgtgagggtctgagcagcaacttcataataattttacacagtcgggacccaaaccgacttagtggacagccagtccaaggtcatatcgcaggtgtgtgtccatgccatccaagatcccgccaaggctcaaaagtacgggggatgcagattgtctttttcatcctcgtcggactccttgttcttggcctcgtgttcatcttcattgccatttttgtcgttaattatatcgccggcattgccctggtagtcgttggtggtgtttgtgttcttttcaccatcggtttctggatcggcgtttcgtgttcccatataaagaagaagaccaaggttataactggcaatcagtgtgtctagaccctgcctccttcttcagccgcatcattcctgagtaattctcaactaatcaatcaactagcttggcagtaggagtacgtagctacgacaaaactccactgtacagtagattctcgtactcgacgtcattgcatgggagcacttttgtcccactttcaacttataacgccttttggcatgacgagctcttgtttttggcaaccttgagagagagagggaggcggagcggggctgtgagagggtatccgcagttctacagtaaatggtagtggtgaatacggtcgtatacattgcgtcgaatgtccggttgtagcactgaagaaatcaaaccgcatttcatcttttgtttctccaaattgaaatgggcaggcggagtggctgataagcagtgctaaagtacttgtacttgttgaaggcaatcttttaatttgttaaattcaaggtatgtcggtcagttgtcagttttcgagtcgcacattctaactggcagtttgtttccagccctttcgaccagtttctacgaccaggggatacttttgtgattgtgctactgagctcagaaataatttagctacaacggaaaaagtcacccactccgttactttcctcggtctcaaggaagactgtctgcttaagactgaggaggtgatggaggctaagacagaaattaccgcagctgtttatcttggctgagatttccaagacactttggcaatagtgcagctgagagatagatgactccaccgtagtactgtaccgctactatcggagtatcgagaccccgcggcaaccaattctcaattccaattatcagcaacgggaaccgacttattattattccccctttccgaagtatgatcaaccggaatctcagtcggagcatggttcacttgacacaagatggacacggcagaagcaagtgaattaaatcttcgatagatgtgtcatgatgtaacacgatccatttatttttgaactatgaagctccatggtatgtactgtacagtaccaacccaactctgtactcttttcacgtattctcgcaacaattcatgtgttattgctgtattatagagtgtcagtagcaagcagccctcatacttacttcacctctcgatgcatctcttgcgtcatcgtcttatcattaccatttcaattactcaccaggagacccagtggagatggggcgctggcaggctcctctccaaatacacgcagctggtatgcacaaggtgcattagcgagaagacactggtacaggtacatgcacaaaatcgtgctaaaggcggatgtcagtgattctagagaaaattagttgcacattaatcatcagattattgcaaagaagatttagggtaaagcgacttcttaaaaaatctctctggtactcctttgaagagctcctacacctactgtatactacatactgtccctgaaccttggaagatatcgtccggctccgtgcggctcattgatcatcaactatggttccggaagaacaataattccgtggtgcggccggataattcaaataaaagtctggacacgtttttatctgcttcgggcagcatcgtgggggtcacagggttccgtctatgtccgtagaggtcgccaaagtggggttatgggcaatggaaaaacgtgaaagttgcacaggcagaaaatattggtcgaagagggctcccacattgtgacgttggagtgatggtagcagcccgacggtttatactaataggtacagtactgtatgtactatagatgaaatttgactactgtacctactgttcaccgtagctgtgtcagatcatatacggaataatcaagaagctcaattgacttcaacaagtactaaatgctaggctagtagttgcaggccgtaggtcccttcgcccggtagagatgattatttgagaggtccatatatacatcaactttctcaagactccccatctcatttcttgttcaataaactgtcatggggaatagtgcaccgtaacggcttaccctaagcttcttgtcttacgagtgtccttccctggatcctgtgttgagaataggacaaacatttccatagtatgtgccaatccagccatgccaccagagtcaagagctcaaaagagccaccgaccgataatgccgaccaaaaaacaacactaagaaacaacgctgaaaagccgcctagagctgaggatggtatgatgccaccggccaccagagcaaggagttgatgcgattataatacgttaagtcatgccagcatgagtgatactgtgaaacgatggcgtaagcaccaatgtgattctgtgaactgtgaacagaatgcctgcgcctttgtacatgggccagcgccaagagccggagccatatctagccaataagtgccacagagcatctaagagctgtaagcgttaagccaatgagagccagagctgaaacaagtcagagcccataagatctaagagctatgacgcccccaagtgccagagccagttcatgataaaagccacagggccgccatatgagtttctcgtcgaggcagtcggggtctaacgatcaagctcgcattcagaaaggatgtaggccgtagaacctcgggtatgaggatttacaccagcttaaccttcagtttaaatacgagaggacgtaagccagaaagctggacctctggggataataagttgtggaccatggagtcagtttttcgattgtagcattttttatacttgtacaggtacaagtactatagttaattaaagtgttttgctgtcgatttagacattatttgcaatttgaagctggacttatgtgatatggtaattttaaaaaaaattattgaattcatctaatttctttaagttttgttttacttatttaactcatgtttaattctttgtattttgtcaagtacttaattgggatatattaaagtgaattgtaatcatactggtgaaatgatggaagttcgaagcggcaaaaaaagaaaaccaggagcggaactactgtgtatgatttcactcacagtctgaaagactgacaaaaagaattacagcacccaggattctcgtatggtctcccactacaatactaactgggctctctggtgcttgactatggctgatcggacgggaagccgtattttcaccaggatatggccgtaaccagtgctgcgccgacccggaatcgaaccgggggcccatcgatggcaacgatggattttaccactaaaccatcggcgcttagtaagcataataggtagttttcttactcgtgcatatagttgattacataagcagaggaagaatattgggcgtttgaagccctacagttgttattatattacttaaagaagtatttcatgcgattgcaaacaacaccagtttcttgtatccctccacggctgcaagcaggtcggtaacggtgatatgctcatctggtgcattggccaaactcatgttaccaggaccgtaaagataccgaacaaagtctccatgaaggtgtggactgtcacttgatagagaggaaacggtagactcaaatccaggaacctcacaactaaagtcctggggtggataggactggtaagtgaatatcacatctcggaatcgtgtgaggacgccagccacttcacttgcaacattttcctcatctcccagaaaccgaacttccacggtagccttttgattgttggtgaaagtcacatttactgttccagagattattgaagtcttgaaggcttgcatcatgtcgataaggacttggttttcgccctctagtccgatgatgacaactccacaatgacgactcaccaaattcaagtcactaggctttccgaagataatagttttccacggtttgaccattttgttcacctcggtcattcctccagatccaaagacttctcctccaaccacaaacaacaatgccacttcattgtatgcaactttcctgtccctcaacagctcttcaagagcagttacttgggcagcaatgcaagacttggcatcaagagctccagagccgtatatggcaccgtcgatgacattatacggagttccacttgtgacgtgatcaacgttgcttgttagcaacaccttggcatcctctcgggctcccttataagcatagacgttctgacgggtatgatctccaatcaagtcgatagtgtaacctctggttgagagataaagctgcagaaaacgagacacgtgagtctcattgtatgacacggaagggatatcaaccaggctcttgtgcaattccatgacagggctgtagctgttagtaccaccgtgttccttcacagagagtgtgtcatgtttagggaacctatgataggcatatatgtagctctttaaaatgagaagagctccacacaccaggaatactacaatcttcctgatcatgatctgtggggaaggtggtggaaaattcgatgagggtagtgtaatgacgcagtagaagagagtaggttagtttgtgtaagacaatgaagatgctaatcgaaggagcagattgtttgttgctctgcaatagtcgcggtaagtattggtgaagtggagggaacaaataaggttgagataactgggattgatatgcaaccttatctacgatataaaaaaatatgatccgtggtgacttgcgaatatgaggacttgatacagccatgggtaggtagaaaaaaaaataccagatcattgtgatcacaaaaggagtggacgacaccggaatcgaaccggggacctcgcgcatgctaagcgcatgtgataaccaactacaccagacgcccaagtttttattgagatgtaggtgggttctgtgtagtttcaaaacttctgaaaaaatcgacgaatcattagaaaaaaaagaaaaaaaactaaactaaaaaaaaaaaaacctcaaaaacataacaaccatacaccgagctactccaacttcaactccccgatgtcgcaaagactcaataacgatacacacgaatcattagaataaaaaaaaatcgacttcttgcagtgcctgtgcaaacggatcgataagttctgtgtgcacactactggtatttgatgtactgtacagtaccgatacttttgtatgcctcgaggctttacgaatatctcccccgacaggtgtaggaatcagcttctcagtaagtttccagaccatgtctacgtcaagttcccagtccttctacactacatattgtacaccatctccgtatatattcataaccattcaataatacaattcaattaaaactttcgtcgctgctgaggcttgcccttgggtttgctcacgccacctcgagaaaactttttggtgggtcgcttgggcaccacgtcgtcatcatctcctccgtcgtcatctcctccctttgacttcttatacttgtacttgttcttctgtcctcgcacaggtccgttcttgatggcctcaacgtaatggtcgatggccgagccctggggaatcacgtcctcctcctcatcctccttaaagatcatcttaccggactcattagtcttgaacttggacgatttgagaagaggctccttctttcctctaggcttggaagaagtgatgtgagccagagcctgctgcgacagcagatccagagggtcgtcggacttcataatgtacttggaggcccgcttggtggtctcctcctcctcatagtcatcctcgtcttcagaatccgagtctccgtacagagctcgctcgtactcagaggcaaactccttcttgggcttggtagacgacatgggagcatcttcctccttctcctcggttcgctttcgcttggatcgctccttagactttcggatgttggtcagcagcttcttgtcggcctcggggaaatgcttttcaatggtgtcgaagccgaaccgtcgaatcagacgctcgacaatgtgcttgaccttggccttgaaatggcccttatgttcgtgggaccagtgcagcagctttgggagaagctcgctgagctggggctccacgagatcgatggggagagagatggccgtaatcttgacgaaaccaagagtcgacttgacgatctctctgttctgcgaggtcaggaacagctcaacggtttgagacagctcgctgagcatgtccatgggcacgtcgtccttgaactcgaacaagattcgggacagacccgtgatggtggcagacaccaggttgggtgaggttcctgccagaccagcagacacggccttgaagaactcagtcaggttggcgttgacggatcccagaccggcatcctcgagaccggggattcgagtgttgtcaattactcctcctcgagccatcttttcgcccatgagaaccagtaagttgtaagcggacgttcgggtcttctcgttgacgtccttggtggcaatgacggcttcagagacggtagcggggatgaaatacagatcgttctcgggcagcagagccaccagcttcgccagagcggccactcgagcgcctcgagacacagcagtgacagactcagcagactcgagaacaacaccacagatgttgtcaagatgcttctccagagtctcgaagctgttgtcggcctcggccagacgggtcaaaagacggtagcccttcttttggtggttggggtcggagttctggatcatctgcacaaagacggtcagcagagtgttgtgagaagaggcagggatgtaaggcacgagggcgatgagaatgtcaagcatggtgagcgacattgctggcagggcgtccttctcaggcttagactccttggcctcatcctccagagccttgtgaagcattccacacacgttatcgaagatgtcgccaatttcgccggcgggggtgatgccgaggtaggcgttgatgcactcgagaatgaagcctcgagactcgggaatagtttgtccgtacacgttgaagagcaccgcaagaatcttggaagacacggttccgaggtaggcaacgttagactcggcctcggatcgggggaatcgctccagaagcagcaggtcgtcgttcacatcctcggactcagcagcctcgggctcctcggcgtacaccacattgctctcgacaagcagacgcagcgactggcagataacaggtcggatctcaatgttggaatagagcttgttggagagcagctcggcaaaagactggtcaaacgactgctggagatccatgggcagagcgcagaaacggggcagaacggaccagacctgggccagcagagcctcgaagacctttgcggtggcgcccttggtagtcgagatcttgtcgtcaaaatactcgatcagtggcaagaactcgctcttaaaaaaggcaatctctgaattgtgaatgttgtctctcagtagagggagcatccaggctcgtccggggctgtcagaagaggggtttgaaaggttgagggggagcagttctagcactttggcaggtcccatggcacgaatagcggacccaagagcgttgtcgagagcaggaatgccgttaacgaaggactcctcagttcggagacctccaataattgtcacagcctccacaaggaaggggtcggacttccatctgagagtgtcgagtagagctgccacaacgttcgtagagtcgacgagagaagcccgggtctggacggacagaagcatcgtggccatctccgcgagcttggacagccacttgtcgccgttctgaagcgacttttggttgatggaagaacacagagcaacgagacactgggaagcagaggttcgcacactgtcggcctcagagtcgagataggcacataccttctggaaaaccacgggggtcttggccaatcccttatcagggttgacctctccaagagcacccactccctgggcaacaacagcaaaccaggcaggagcaagatgctggtcgttggtggcgggagcctggtcgatcacagcatcgagaataaccagcaattttcgtgtcttgttgttctcgtcctcttcagacttggcaaagtgacggaagacaccctcaaagatgccaaaggtagcctggatcagcatctggttggtagtcttggaaatagacagcagcagctgacagagttcgtcaaactgcgacataggccacattccaacgccacagatggttttcaccagagccagcgcatgcatgaagccggcatccacggtatcctccttcttgtggttctccaggtactgcttgacggccttcagggctgtgtcggcacaggttgcggcagcaggatgctcgacgagcactggagatactcgggtctcgaggatcttggcaagtgcgtccagagctcgctttctgatcttgggacggggattgacggccagatgcatcagaccaaccactcctcgtcggggagacagctcagaagcaggggtctgccacgaggcagcatcctgggccagcagcagatgctgcagagtgccaatggcggatctgagtagcgcagactcggaatcggacgagcccaacacgggtgcgagcttgacgaaaatctgcgaaaacttggcccgcagaagagattcgctggcgaagggagacacaaggtcgaggaaatagagagccgaggcggctagatcgatattctcgagctgatcgggggcctggcggctgaacgattgctctagcagagcaaggaaagaaatgaagtaggaggtggcggtcttctcggtcttttcctcctcgagattctcctccacggctcccaaaataatggccaactgtttctggttggccagcttggagttgacatggacgcggatccggtccagcttgtcctccagcggttccgtatggtcgagttcggacatttgtagatggtgcgtgcaactacgattgtcactttgcagaagacttgaaaaaaatattagagttgatgcactgcgagtttatcaggttggtgggagaagaggtggatagtggtgtgggctgtttggggagatttctggggtaatacgagatggtattctggtgtatattacatttgtagtagtcttaacttgttggcattccaatatcatgtctccactgtggtattatggttgcggtgtcacccacttcgattctcggctattcctttttttaaaaaagaaatagaaaatgtcaaattctagattgacactgcaatgggagtgttgggggtaaacttctgctgtaaggggacatgcctctgtacaagtcacaattacagtccaatattatcgaatatactgcaaatattatacaatatatattataaaaatttatattatacaaaattatattatacaaaattatattatacaaaattatattatacaaaattaaatgttgatatatttatatacaatctcttcatacccacgcacagagccaccaaataagaagttcactgtacacgatttcgaaaaatattggcaagacacgagatgtggttaagcaatgttctttcgacaagtccagtgtaacagtgttggggtcaatccattaaaggagaccatatgctgtgtccctccaggtgcgtgctgtgttgtatcttgtgctgaggagtccgacctcttctgttcattcagacgctcctgtgctcatgttctcatgaagtcattttcaattcatcaacacccatgatcttcaattcaaccctatagttgagtaacagtcgattaaataaatcagactcgttatgataccgacaaacagcctatcatattccgcgttgacgttggacactacaacaagtggctgagaaactacttccttgcccaaattgaccgagacagttcctctgcggaggaccgctgaatacttcttccacgggaactaatctaatgttatctaatgcacgatattccatggactctgatgtagacaagctctccagattcctggattctaaacaccagttttgaaatgaattgatgccgaacccagcgattcgtcgtgacacagcagattaaccatgcgcttacagccttccagcactgacaaacaagtgccagagtccaagttccacttctgaataaccacataaggaaaccccgagtaacatacacctctacagtaatggggacatgagcaacatcgtacgcacgcttttaatgtccttcaagcacatattggcactctccgggttagtcaggatccctacacgcactgttgtacaagaatccgcacaagggtatctccatggatgtcagttgctctgagagaattcatacagcccgcaaaatgtgcacaggcactgctgtattctacatgcctatccttttcaggaagcttccacaccctcactctctctccagaacgaatgtatgtatcactttgtgtcagagaatgtgagtgtggatgcttcttcttctctttagcacacgagtgcattttctgcttgatgctccacattttcatagtccaatctctggcgctcacgactgtatccctcagattggaggttgaacccaaggctgctgaaggctcctggtagtttgacatgactgattttcaaactttgaaacagactcagagtccttcggtggtggcttttcttgcctcaaggactctggaatcttgtctaccatttccaaggacggcacagtaccaatggccttatgtttctttacccaacgtacttgtctgttgaggatgttaatgtctcagctctcgttaacgaagcccctggtctgtctcttctgagctgtcgcttggagcttctcttgttctcgctgttcttcattgaacatccctcagcaaatgaatgttaaataatacttaagacaatggcttgtttgttaattagttagaattctgagtaaacacttgttggccctttgtttaaacgtgtcagcaaaactaaacttctcgaaatcctaatctcgcatcatccatgcaccgtgcctgggatggcagtatttgagacgatcacgcgaagagcgttcatcattaaattttccacgtgcaactaagctctcgctagacctggtaatctcagagctttagcagcaaatgctaggtgtctacggtggtgatatatgcggtatcacaatagaatgttggctcacacattagtcagtcttttaaccatagcagtgacgcccattcagacccccccatcatctacaatgtctctaatcatctcgcttgagctctgtcgtgaatatcaatttcatttgagccaacgggaaccttgagttcttgggtcgtatcgtcttttctttttgtccagaccaatgtcatggacggatgagaaacgtgcccatacagagtgcaaagcaccatgtcctttataatgttgcctaaattcctcattcaatggctcagatctacctcttaacgctttctcgcacacatggttaacctcttacagctctctactagcctgctggctgctgctgggctggtcaagcgagccgacaacccctcctctcatcatgtccaagttcccaacattggaaacgacgcactagttgactggggttacctcgagacccagaagatcttcaacggaacaggctccaactgtaccaagtgcctgcagggcatcaatcttggcaagtacatcactctccaggctccgactgtgacgccccagatcctcgtcaagctatgcaccctctacgactggcaggacgactgcgacaagtggcaaggaagtgatatcactaagggcaatcccggtaagcacgtttcgcaagtcttcactatcatggacgcctttggactggacggaatcaatctctgctactggactgctcccaacacctgtgatgctgctcccgttcctgaaccagatttgtcgtcttggtggcctgaaaagcccaagaacctgtcaaagatcgaatccacctacaacgagaccttcaacgttcttcatatttccgacttccatctcgatctacgttacttaccgggtcaggaggcctggtgcgacgcctacatgtgctgcacagtggagtctagcaacaagaaggcactggcagcaggactcaaccataccgtttagtcggcccagaaactcggatcgtaccattgtgacgctccagaatcgcttgtggaagattctctcaagactgtgggggcaatggctaatgcacgagactttgaatttggcatcttcaccggcgacatggtctcccatgatatccaggactggctctcttttactcacacataccagtccgaagaagaagtgtactacttgatgaagaagtatctcggggacattcccgtctacccaacatttggcaaccacgactcatacccttatgctcagcttgcccaaaattcatctggttttgcaggcgagttttcctggaacgcagagctgtccgcaaaaatgtggaaggactttggctggatcaacgagaccaccgaagcccaggctgagcacacctacggctcgtttgcagtgacaaccaagagaggtctacgggtcatctccatcgactccaacttctggtactcggagaactactacaacttctggaacatcaccgagcctgatctgtctggaaccttcaagtggcttgttggtgagcttctggagtgtgaaagattcggtcaaaaggcctggatcatggcccatgtaccttctcaggagatgggtgcggtcccttgggcgactgaggtgtttaggcaggttatccgacgcttctctcctcacgtgattgcagccaacttctttggtcacacccatgccgaccaattcagcgtcttctatgaacaaaccaacgtgtggaccgaagagtctgccatctcagtcggttggattattcagtccgtcactcctgttgacaaatataaccctgcctggagatactacgaggtggacacgaagacttttgagatcatgaactccaagaactactactcacctctcaacgagacgtacgagtacaacatcgacaagtacaagaacgagactctaggaaactacacttacaaggtgtacgaaccccagactcctaaacaaatgacttggatctgggaatactctgctcgagacgcctatgatccaaacaacacctggccccataacgctccccttaatgccaccttctggcatagagctgccaagggtattatcgaagatccggcccaaaatcagctgtattacgatcactacttccgaaagtcgccttatactcagcagggatgtgataaggaatgtcttcaggatactttttgctcgtttgtagccggttctcagggtgagcgaaccgactgtctcaagcttgaaagtcttcctcctttgtaggtaagactacgagtacgtagtcgatgaatatagaaatagaatagaccagcgattggctactggtgctaacgtaactatgagttatattaagccaatatccatatataattaatattgccatggcaagcatctaagcctgtcatggccttgtacaagtagtcacagctcgctacgcaaactgcacctactgtgtcaccctctggggcatccccagcccatggttctccttgtttcctcctctcacagggctcttcaactcatggttggaaacgcactttctcaatgagccccgaataccaaacttgccactcgtcggagtcactactcggtttgcacgactgtctccgtcagcaagaatactcacattcgagtgattgacagcatcggaaaaatccaagggtggaggagcagagtcagggctgtccatgggatgatcaatgggtgattccactgctgctgcaggaccaggcagccttgagggggtactcaagacattggaagttcgtcgaggagtcgaaagggcgggggaaggtgcccatctcaccctcttggagggtttgtctttgggagggggttgaacaggagatcgaacaactaccgatctcttgtatgccgaaggaagcgaaaagtttggggtcgaaggagtcgggatcggggctgtggatacgcttttaaaaacgttttcacatccaaccaaagcttcagacagcagccgcacgtgctcctggtcctcaatgcgctgaatcatgtgtagacaagcgttcatgaactgcgagacaatgggtccaaaaaacgtgtctgttagagacacggacgaaacacactcatggaactcccgctcgtagtggtcacgtgtctgttcagcccatatcaggaatagctcctcatctgcctcacaccatccttctagttccttcagacgccgcaaacattggtcaacggtgttttgagcggccatatcccgtgtgcacgaatccaaaaaggcgttgatggcctcaatatcgctgcataatcgtttcagacgatcctgagcgtcgtccacaaagtacaaaagctcgggatacgcagaagtgagcgctccaaagtctgggccactcaacaactgcatccacgacgtcaactgggactgctgaagggtcaacagcttgatacgatgcaatcccatgacccgctgttcagtttccgatgtggttcgcgagtacgtggtctctagagacgttatagcctccttgatggcgtctcttcttgtctgttcagctgcaacatacttggcaacagcctgctcgatagcctcagcctctcgctttcgaagcgtctcaatctccgttcgctgttcggtgatcatcttcagatacgagcccacgtgtctgtcgagcgagtgctggtttcgaaccacctttgtcttgatcattttcgctctgtcagcgtatttgagcgtgttgagggtctcgtcataatgctgagaagaaggagaaatgcatactatcatcaccgtcttgcagttgccacccagcgagaacttgagcagtcgcgtgagtttggagtttctgtaaggcacatgcaattttcgtttggggtcacacagagcgttgatgcagttgcccagtgccaaaagagacttgttgatgtttgcaccctccagcaatcgctctcctctgttctttgtggcagatgcacgctcactaccggccaggtcgatgatggaaagagtagcaaaagtgtgtgactcggaaagctcagctgttcggttcttttgaatgacgttgatctgcaacacggcatgtgatcgcgacgacgtggcgttggcctcagtggggctctgtgttcggttggtgttgccttgcaaaatcatctccatgacttcctccacagactcgggtttgtgcgacgacaagtttgacaccgagattttcttgtcggcgtcctcccgcagagtcagcaccttgtcgctgggctccagaagatccttaatggtttcgttgtaaatctccaggtagctgagtgacacatcaatcaccttttcgtctcgcagagcctcaattctgtcgaacagctccttcatggtcagaaacaccactcctggcgcctcgggacgtccactaatcgtgtgtgtctttccacatcccgtagctccatatgcaaataccgtggcattgtatccatcgaaaatgttggacagcaacggccgagtagtctggttgtagacctgttcctgggacgcatcttcgtcaaacagctggtcaaacacaaaccggtgttctctgatccgatgtgtgttgcccggaaacgcagccttgtgcatccctgccacaggagacgattctggcgggtcgaaaatgagcatcttgtcgtccaccacgttgatgatcttgcggatgcttttgccgcccttgcgagaagtgaacgggttgaccgtagccgtgttggtcgacgaggaagctaaagaaccatcgcccagaaacagctgctgcttgggattgtgctggagatatgtctgttccgtttgcgtgaacggccgtactctgacggccactgaaatagaagactccatgttgtgtgtgagtacaagtagtgggtctgttgagttgcgtttgtcgatgtcttgtttttgtgtaacttctttctgtctcttgagtgtgttcgtttctgtccgtggctggtattttcttgtcgtttcccgctgtctgcttcctctcttcaagctgtcgttagtgatatccctttggtgtgagttgaaacaagaatatatccacacacatgatacatgtcggtctgcaactctattccagcctaaacataacattgaggatggagaaatgggtagatattaatgaaaagaatatgacactaattccatggacgagctgtctcttttggtgaagtttccagaaaattccatccattattcactcctctgtatggattctaaaacatttgcaaaacccatgcacctccccaacactatcataacaagtgccagagactcgtgtgaaacgcgcaaattttgtcctatcgaaagaataaatacacaggaaacttcagaatccgctctgctttccccttccagtgtctttactgccgagatttccccttgaaaccgatattatcacctcatccaggcacacatgcagcttaatgctacatttaaacagacagtccccggaactacaagtagccgtttccgcggactctgcatcacgtgaccttctcaaatactctcctggctctctttctcttcaaccctaccattcgaaacacactgtttgcttcacaatggggctaactctgatgtttactattgttctgcatgtttgttgacgtttgctgcatgccgttgtcatggttactgtgcggctggaaaaaaaaagtgtgtgtgactctgggttcgattcggactcgtgtggattttgtagagggaaccagcaagtgtttagggatttgatggaagtttttcttcgtatactgacacaaatgaatctatctcgacctgctaggatatatcatcacactttgaggcagtctacaagctgtgcgagagtcaaccgaagtcccgggtactcgtaaacaatttcaacaatatcagtacaaggtgcatgcagtgtacttatagtaatgcagtgtacttatagtaatcactcgtaaaatctgtggaatgactgttttctccaagtacttgtacttgtacttatagttgtactctcttgccacatgtgctccctttcgatggagttcttctgaaattcaggtttaatatgtctcgttcaattaacccgtccaagtacttgtataacttgtacttgtacaagaacattacctaatgcgaagctgacgcattacataatcacacaacggaatgctcatctaaatgacacaaaacacatactaatcaatatccattgacccatagaagacacaaaacactgtcacatctcattgttatcttctccatccacaacaccctccctcatcccgtatcttcctcacacagtagggacagtacatacgtatctatagtatactcctccccacagcggtatctggaaccctagtggatgttaactttacgtgagctcatcggatacagcaggcgagtgtctcaattgggctgcacaagagtcgtattgctctgatatttcgacagcaactttttggtcacgtgagctcgtttccgtgaaaatttcggcccaaaatatccgtttcttctcctccccaacatgcacatttaacctcccccctctctctcacagcaaggttaactctcccaccatgaaccgacttaagaccgcctcagtgcgacttcgccagattcactaccagtttggcaaattcggatatcagggcgacaacatgaactccaagtacgccggcaaagcctacacggaaaccaccgtgcacaagtatcaccgaaacctcattggaatcgagcatcccactcggtatggagctcctcacacaaacaccgtggtcttcattgggggtctgggagacggaatcaccacagttccgtacgtcaagcctctggcagatgctcttgataaggccggatggggcgttgtggagctcttgaccacttcttcctttggaggatggggtacggggtctctggaacgagacgccgaagaggtagagaaagccgtggagtatctcaccaccaagctggaggctggcgggttgcccaacaagcagaaggttgtgctgttgggccactcaacaggctgccaggacattatgtactacctgaccagaggtaaggagcgagccaagatcgacggagccattctgcaggctggagtatccgatcgagacgccaccgtgctcaacattggcgagaaaaagtggaaggagaccgtcgcggcggcccagaagcttgtggacgaaggaaagggcgataccgtgctgtctggcgagtttgccgagatcatgcacaacacccccatttcagcatcgcgatttgtggctctcaacgctcctcgaggcgacgacgacttcttttccattgatctgcccgattcagacctcgaaaagtcttttggacagatcaaggtgcccctgctgttcctcatgagcggaagcgacgcatttgtggaccccaagcaggacaagcagaagattgttgaccgatacgagagctttgtcaagggcggaaactggtccgagctgtctggtgtcattgacggagcttctcataatgttggacgggatagcaaggagggagctgttgatgctgtagtggaaaagattgagagtttcgtgaaatcaatctagggatctccaggccgtactagtacacagacatctgtatgtactagtatttccctcacctatagcgagctgtctttctaacatcatctaacgtcatcacaatacattctacagtatctcaaataccgtccaaaataagcaaatcaaatctatatatattacagctaaatactccccatccgtatccagtgagtctatgacttctgcccttcattctaacccgtcttacagaagagtatctccgcaagcactcttggcgagggaaatgccagcgctgatggtgtcgtcaatatccttctgagaagcaccaagagcggggttgcactcgacgaggtccatggcgacgagctttccggtggcagcaagctcctcgcagatgtagcaggcctctcgccaggtgagacctcctcgaacaggagttccagtggagggagcaaagaaggggtccatggcgtcaacgtcgaaggagaggtgaatgggtttgctgagatcggggttgaccttctgcagagccatctcgaccacctttccaatgccgtacttgtccacatggtgcatggagtaggcggtgatgccatgttccttgatcatcttcttctcaaagtcgtccacgtctcgcagcgcaatgtaggcgaggttcttgaagtcgagacactcggggacccatccgaagggatcgtccttctcgggcttggcgagcccggtgacccacgacagaggacagccgtgcaggttgccagagtcggtagcggcgggagtgttaagatcgcaatgagcatcgacccagatgaggcaggcgtcggggtacttctctcgcacaccggcaacagtgccaacagcgatggagtggtcacccccgatggtgagcacaaaccgtccagagacagcagcctcagaaacagccttgtagacccgtcgagaggcctcagcgacgtaacggggtcgcttcatcttgccaatgtcctcgtcagactcgggcacggggaactcaaggtgtccgtcgaatttggtgtcccagtcgaggctctggaggtgcttctcgagacctcctccgagcaggtactcggggcccttgtcgacaccgcccttgggctggcctccggagaagggggcagagacaatgctgagctttcgttcggggaagtattcaaagttcattgtgttgtgttgtgtggtggtggtgtggtggtggtgatggtggctgtggtggtgatggtggtggagatcaaggtggatcaacgcggaatcagaatcagatcttttgtatgaacttacacaaagcgtaggtgtcaagtccgggcgtggtagagatggtggagaagaagaaacacggtggccaaaatccggcccttatataaagaaaaaaatcgccgttacacccctaagtgcaggaacaggcgatgaggtgtgcatgagtagacggcgctgccaaaagcactagaaaagagccggttggggggtctcaccggacgaggagagagcgggtcacgagaccaaagaaaaccgcacgtggttcgacacgaaaaactcccttttatacgtccgcaacgccgccagagtctcgcactccctcctccaaccaaaatcccacgataacacactcgaaccaaattgagttttatgaaaaccgtaatgcaacattttagacgcactacaacacgatccatgaccctaagtacaggtgtgagcgagtgaggcatttgagggggtcatgaggggttgccgtgcaagtggagaagggagcagagggctagggtagatggtggaagtggcaatgatgattataggtgggtaagggttattgatccctggtgcctgtttgaacagtgcgcatcacccaaggtgccatgtgctcctgtcaaaaagggtctaacagcttccactggactctaataatagccgttgctttttgatgtttctgatagcaaatgtttgaagagaactttatcaggagacgtgagttcgattcaccatggaggtggatttgataggtatatttgctattcgccagagatagcttgtgactttgagatagggcaagagatggatttttgtagaggagtgataagataaaaactggaattctctgtaaacctgtcagttcaagaaggatacaatcgccccggggcgcgttggtgcgcgtaagagaaggaatgtgtgatttgagtatctcctgtaatggtgaaatttaaaaatatttataggaaaatatcataaaagaaattaaatatatgtcgatatggggaagatataagaagataattgtgaggtgaatatctgggaattatatagattaagataattttgattaaaaaaagtccaatgagctatcacttccataggccccaatgactctacttgtctgatccgactctgacttacattgccttgattatgaaactcggccttgacgactccagttggcatatatataatgaattatatatagctgttggagctgactattctaacgaaagagttctactcacattcattcttctcataagctctcttagttggctcagcttgtgtaccatgggggaggagggatgagggatgaggtctacacgaagtaaggctagaagtagttcagatacaaagcatagctctactttggcgtaatgattcactcaattatcatttgagatcgcactactactcgatgagcgtctggaacaaaagtcgtgcgatcatagacattcatagcatgggttttattacgaatagctcccccagatgcgttggcacagtcttagggtactgtactccgtggggtcattaatttggaacgcggttgtatttcattaggtgttcctcacttaacatctttgtttgtacaatgtcttccttcgttgtttccccagatgcgtaagaatgttccgttttcactcatatacaagaagtgattactcaactgtgaatacttcggacgattattcaggataaatgaactctcagactgagtcgctagcttctagtggttctatatgtttagcaaatgacctctctccaagatctctggaatacaacatgcttttcacaaagacagagaaacacttgactcaattagttctaaatagacacaagagctgccagttttgccaatatcagatctttgtcagtctagaatgttgtagcttcctgtccgtgctactttgtaattattggtttggagaggtgctaacagtagtcaatcagtagcatgcagcaatgacgacaaccatttacgacggatactaatgatagcccacttttcaatgagtacatcatgaaagatggcttgaaaagtgacatatgacaacaattgttatgtacactgtaggtactgtactgtatgcagtaagacatgtgctagaagtcatcaattgacataattatcttggtgcagagggtctgacatatacaagcctctctgctgtttaaatcacgactatattggtcctataaccacaccaggagttcactaaaaccacaccaaatgcactttaaacatttaaaacacgttcttccccaattgaactccgtctggactctttcaagtcaatgatgtgtgacaaaggttgcacctcgctgtacatactgtatctgtatagtacatacagtacaatgccaattcacagaagctgacgtcgaacatctgacttagcggctaataaattggctgatacagccgtatggaattatttgtttcattgcaagtgcatgtgtcgcggtactgtacctggcatgacaggagtgtgtctgtccgactacttgtagtgtgatagtgccatacagttctaccgtctctagagcacatgagttcacggactattgatgaatgaaacgtcggtttgctggttataagatagagcccttgatttcacgtgtctacagtgtccattaccgcgtttacgtctctactcgtaagtactggaactacgaactcacctcagacaccgcatatgctgcgagacagatggataaaatctgtgacgtgagaggtgggaggtagacttggtatttatttattttcattagctatgtgcagtgggttctacaagggcgctacaagtagttgtagggtatgcaaggagggtatatatgcgccgaatagaagtatcggacccggagagaacgacaaggaaaagataaagggtacctatagttccccatgttgatacaccggctcacagttgaggaatgatcacatgctggtatcgttctgctgtctcaatgacgaccatgtctgtcagtgtcctctcaagcgaatgcaaggagaaagacgtggaagcggtatcgtacgagggctggagttgtaatataactttagacagtccaaagtaactgtttttgatcaaccaaggggcctcggttattgtccttgcgctttggccaagatgtctttcagcatggaatgtactgcacataccgaggatcagataatacgaataaaacgcgcctcgagcccagatattttatgcaccttaaaataaaatgaaatttccactacaagtagcaagaggggaagcaattcgccgggtttatttggcatccccggttcctctttatgtcaatgtcaattcacggaataagcggatggagagctagaacagtatccgaaaccccctttaaccaggaactgaatttggtgctgccctgaatctacaagtggctatatacttgagtaggtatatcataataaatgctctcagcgatgtgcaaaagtggggaatggctcgtaatatgaaatctgctcgtgtgcgtgcagcgaacacccgcgagctgtgggtctgtctgcgaaatgagccgtgggatgcccgctgttaatctcgtttctgccgacccactcgtacagcaattaataccgcctacatgactgtttgttctggttgcgtctggcagaagacacaatagggcgtatgaaggatgcggcgagacggtcaaggaagtgaccaatacgccccgttgagaccaactcgtacgattcaaggggtacacaagtatgctcggcgccatcgactttgagagccaacgccgttttatacggatgtggattttctcgtaaaaagatcgttaatttgaggtaatagagcgaaatctgcatgcagacctgtaatgcagttttatatttatttttaattatattatttatgcaaattttatcgtgtttggaatatgcagaaaatattacacggggccatttgaatattccaatgtatacgcagtaaagtgataataaattctggcactttgggggaaaatatcacagacccctactgtacttggagtgtctcatcctaccccgctcttgcccagagctctatctctttccgaacaaacccaagaaacagtggacctgctgtagagctgtggtttcaggcacacatgagcatgtagctagagaagaccaaaagtagagattcctccggggtctggagatgcattggtatgttgcggcagaagacttgtttcagccggattgcaccgccgctcttcgcttgtgttttctctgccccgcaacctggcatcagcgttgcgctactgtagcaagtgggggccgttagctacagggtgagacaatcagctgataagtgcgtttaaacgagtggagatgatgggggtgtctgttgagggtagatggaggtcaactagagtcttaactgcggatttgaagctgggcggcgactgttagtgactgacaaccaatagtgcaaccgcgcaagaggtgaatatggacgacaggggataagttttgctcccaataacgggggaaaaatgttgtttcgcaccagtccatggctcgctcttacgacccaccgttgaagtggcttgtgcttatcgatacaaggactacttgtagctacacaaggtaataaaatgtcggtctaccccactttgtgtcttgtcttggttattttgtggggtatgcatttttccaaacgctgctactggcgggcctgatgggtttgcgcgagaaggtctttttggccgcagaacctccaaatcaagtctcgcaatattatctcctttggcttccaaacacgccgtattgggccgctcttttggcacgcccctaccgcgatatccctgccttgatgatcctgtagatctcgggttgcaaaaagaaacatgcgtcccagtgttcgaatcgcctccccaacctttaagcttaccgggacccttgtcgggttacaggggtatttgttggggtgttcagggcggagtagatgtgggtgtcataaattggataagatccatgctgacaattacagactccatgtaccgccttccactttagccctatttctgcgctgccgtttgtcccctgtatcaccggtttagatcctcaaacaagggtgctacgtggattcaaacaaggttcccacaaggttcgtcaccgtagaacttgtacttggagagtgggagagactgtgtttgctggggattgtaccgtggatcttttgttggcgctttcacgagctccctgtgaaaaataaccagtgtagaaaatgcggccaaaaacaaaaaaaaaaaaaaacatgaataaaacataaaaaacaaaacaaaaccatgaaaaaacaagaaaggatcctggactatgggtcataacagctgcaatatatataattcgaggcacgacagtgtccccatggcagtcataaatgcccaattagtctagctgtactttgtgtcagacagactacaagtaactgccgctggtacaggatgcacagagtgtatctatgatagtgtggagagcgaggatgggaaaagcgcaaaaccaaagcacgatgattagacaaaatagacaaaacgaaaagaaaaagaacggcaaaaaaaaaaaaaaaaaaagggcaaaaaaacaaactgaaaccgaatatcgtaataattcggagtcatcaccctaaaccagaaaagagagagagaaatacacaaaattgtcacaccactagaaccaagctgaaagattcagcgaagggcgggtgtgtgaaacggattgcaagacccaacagttagtgtccaactcactttgctttttccagacatttttcagttacacttgacttgcctctttgcactacaagtagctcagaccttgacagcactgttactcgctacacagggtttagcggcttcccctcttgtcttgtgtgggtgtggaaagatatatagaagcaggagggacgtgactttcggcacatccacgactatcacgacgatcccactccccgatccctccattcacatgcgcgacgagagtgtggccagcagtggtgtccgtggactcaattacacagacaccagcagttactcaaccaccaccaacgccctccgcagcaacaacggccgcagcaacaactctacttatgccagcagcatgtatagcaccagcagctcgcacactagctccgctctggacacgctccaccagacccgccgaatggctctggaccgtctcaagggatggcgcaagtcgaccgcgagtcccaaacccacacctcagtctgcagctgcactaggtgcaggcccacaaataaccttgcagccgctgcaatgcaaggctaacgctcgcgagcccctgcaacaaagagatatcaccgatcccaggagtctagcctaccaagccaataagtatactgtctcagataatgcgtctattataaggagacaccgtccggatcaacgctctcggaaccagaacgatttcaatttagccagcgaagaccctttcagcgactcctgctctctcagaccgtcgtctactagaccctccacagcagcggcatccaacacctccaccaacaagagactctctgtcgcgtccaacttctctctgaaacccacccctgctcctccaagtgcgacagctcagagtatcccctgtgacagtccccgactccgtcaatcgagcttttccgagcgaccagctacagctaacatcccccattccccagacctgtctacaatgaccaccctacccagaacctacacaacccggtcgcaaaggatccgcattcctcagaatcccgtatcctgctgggacgacgacgaagatgaggaagaacccaagaagggacttttcaaccggttcaagtcaactcgttctttctcttccagaaaggcctccatcagcagcacaacagagagcattcaatctgcccctgcacagtcccccagcatcaagagcgtgagccccaagaactctaagacgctcaagccgaccaagagcgtcaagagcgtcaagagcgtcaagaccgccaaggcggcgcccaaaaccaagtcgtccaagaagggcagcctgggcaacaagtttggcattgatgacctgggcgactttgagtggaacatgcacgcatacatggagggcgatgaagagggtagcgacgccgaaatcgaggcggccctcagacgtgtgcgagaagcggaggctaacgaggccaaggaaaccacccccacccccacttcgcacacaaccacaaccacaaacaccacaacttctacccgagtttccacctcccacagcactcccactcccgagtctgtgtccattcccatttctgtcgcaagttccaaggtctctcctgttctgcctcctatttctccctcgcaatctcttgatctcggtctggagcccactgccacccccaccgctgtgcacaacgaacggattgagaacgaaaacatcaagctcaacggcagccccaactacgctcgagaacacgtggccaacctgctccgtcgacgcgcaaactccggcaaccaatctcctgttccccagactcccgtccctcaggtggttgcccccgagcagtgtccctgggacacatggaagtacacctccaaccaccacacataccagatcactcctccggattccacccgaagcagccacgtgtacgcttcggacgctgcctacgacacctcccaccactcgatggtgcttcccgagtctcctgttcaactccaacccacgtcttccacctcgtcttcgtcctctgaccagaccaagtggaatgacatttcggcaaacattgcgctgatccagcagcagattcaggaaatgtcgcctcgatcacgtgaattggctcgtggctttgccgccaaagagctcaccaagcctgcgaccctggttactccaaccaccatttctcctgccacctttgcaacccctcctccccgaccctccagagacaatgtcgagctgcccgagtgcttctccaagccctttttgaccatgaccaacagtccctcagttcgaccgttgccccgacgactcaacaagctgggtcctgcattggaggagagtgatgcttctcctgactcttctcagagaagttcggttagtacgagattgagcactgctcctagcagtcctgagccggatatgcggtgttttatctaaacgaagctgcctaaatgaagttgcacaaacacacgaagaactgtatggagtgcaatgagagttttgccagctgagtggagcatttataactcttgggtgaaatgattccctataccccattcatgtgtacctttgaggacacctccagcaccttgtgccaagtagactattttatttatcgtgattatgattaagagccgagtagatgagggagatgaggtgcagtaagtaccaagagttgtacgatagttttattcctatgcatcaggagatgagactccggagcgactacttgtagtacagagtgaatctgacgtaaccctgattcggtgcgtctctttgcatctttgctatctgatacgagttgcgtcgatacgtctcatcggtgtcaaccactgtacgatacgatgcgatacgaggagactcttctgtagatagccacagacataactgcatgtatgcattccgctctactggcatatatgggacgatacggctgtgtttttgttggtttgagatctgagtcagggggttattatatttgatacagtgcttgttggtgcttgtagaatgctgtgtataccgagcccacggagtgtcagttctagaccgcgctaaaatgatcgaacctggttagtgagaaatgtctttactttttgcgtcttctctgaaacatttcttttctgtttgctttttagtgtggggatgtcttagcggtgcaggttggtgcagtctgaccaagatacgttgtattagttggcatttgttcggagtattagttagaagatacaagagttccaagtacaagtgacaagattagttggagggactgaagacatcaataagtgcagtacaagttgtactacgatacagaatggatggagtaaacggagaagatataagtgttggaatggcacaaactgtgtctccacctcgtgctcgtccacgctcatctcattagtttcagaagtggcatgtctcggagcaattttcgattattcatcatctttgttttgacgatcgaagaatgtgcagaaatgcgagaagaaaaatcacagaggaaataactgaccgacgaaatcaggaaaaaacctgagagtatcactcgtctagtcgacttaaatcccctctctagcagataggcagctaaatacaccagttggtttaatttttttgtacgatgctgtacatacggtacgagtacatactgtagtgttcattgctgctggttcttgttaatgtgaaaccatggtctcaaaagtcggactaaggcttgtccaatagaaatgagacagtcacagtttcctgaacaaagccttgtttcagctgagtaaccagaatatgtccgaagtggtgcattagcgctaacgcaccagcagatattacggtcacgaggtcccaccagggtttagaccacgctaaccaagacaagagatgcccaagtatgagtatgtactgtccttgtacagtagaccgatgcagtcttagttgcgggtcgtatttgagcgagggagagagggggagcgggggttgactatgacgttcactatcgtcaatcaccaactatacacggacctattgagaatgatggtgtcaccatactagaacgaggagaagttagaagagagattcagtactagtagttaaatgagagtcttcgttaagaaaaacctatgagtacaagtcggtagatgtaggccaacggtggcagtgttggttgtctttagcacccattgatatctgatataataatcgaaaaagacacaatcaagtgacaagtgacaaatgaagatgacaagacatattatcgcactaataatacggggagacaacccattattaccccacagaaccgtcttatcttattataataactatagcaacgatggtgttttcgttcgaggctcagtctttagctaattgtatgagtacgagtacatactacagtacagtaccggtacagtaagacaacgagttcaattgcagcgtgctatttttgaaagatggttctggtgagttcgcttgtctgcaaatcagtgctgtaaaaggacactttgttgctcaaaactattaagcttgttggacacggcgctgctctgtttacttagctaatgatgatctcctctgatctacccgaagatcctccagggttacgtgatcaacagtggggttcggtcgatccgaggatcgtcaatgtcgtactgtgcggtactcgttgtactgtaactgagggatggtgtagcgtacagttcatactggtgtagtgtacagttcatactgtgtaccagtccagtagcagtagcgagacgagatttgaaggcaggtggttcatgtagaggtggttgaaggtcattcgtgctcgatattcaatcacatactcaccagaaaagtacgtacagcggtacttgtaccggtacagtatgtactgtacttggtactttcgtctctcaggcacagatctgtccacaattgccatttcacagatctagatcagatcatccatgattctcgatccagtgagattcccattgtcggggtctgcctatcaccagttgaagactgtgtgatcagtgcttttgggtggatggagtgattgagacctggaacacaactattcatttaattaatgccgttcacactgttatgaaccttttcaactaaaaaccaaataacctggtcacataccaacaaatatggggtctctgataaacacattaaaccgtcgtaaggagcgcagaaacaaaaggccatgagagaaacagtcaagaacacctccagctccgcaaatcaccttccccggctacacacccacacctgcatgcatatctaacatgcacatcatgcacaccatctaaatctacccatttgcaacaatcaccaaaaactgataccaatatggatgaacgggatcacgtgagagatcagagcgatgtgaatgaaagacacaataattcatcacctaatcacgtggacatacctccacaaccacgtgattcacatctcagtcccaaagtgaaacacacgataaacgaactacgcgacagaacgcgattgtcacgtgataacatacgatcacgtgaggcatcaaggccacatttcccaggaaactcacccgggagctacgaattcccctcacgtgatcgcaaacacagctcacacgatgttccatctctgcttactacgatatcagcccttgaagcgcgattaactggcaaagatgcagagattggtcatcttaaaaccgagttaaccaaagcccatgaaatcatcgaaacgctacgggcccaaaaaagtgggactcctgttggtcacgtgaccctggaggaccacaacagccagctggctgcatctgccaagcagcttcatgaaatttacggacaaaaggttatgagcaaggtgcaaaagtaccgttcgcgcaagcagagtcaggtgaagtcgttgaaagatcgtatttcttcgttggaatccgctcttcgtgacagtaggagggagaacagtgaactagtggctgctgtcgatgagtacattgatgtcagtaagacctgtgatgacgggtagagtcaatacgaggtgagggggaaagtaaatgcataattggttgtattttagactgtcagtgtggagacaggactgtatgacacttggtgtcacttgtttcaggggtttgacaggtgcatacatacaattccatcttgcagtagcgctagatacaacaaaagcccctattagaatgattgtaacaatgtagggagttagtaggtgttcaaaacaaaccattcaaagcgctttgatggattatcatcaacaatatttgatcaataatcacataatcagaagagataaggttgcataaccgttagttagtttctgaatgtcttctagttagagttgattaagtaaacaccggctgaaatgggaggctctagcttgtgctgtagatgagatagggggtaaataatttaccagttacttcttaatatccaccttagcacatggttgaaatttcacacccatagtcccacaaatacgctatgtaaatactctttccaaaaaagcacacaacccctttgtttctaaattgccttcttcccgtcactctaaaattccccaccagacgggtcgcacctaagcgagacattaattaaactgtgaagtgagagtgtggacttgtgtctttatcttgcggaaggaatgaggtggacaagaagtcggttgtgttttcggatagctggagtcgagaggagtagattgcaggatttcttttagtgatacgacgaaaactggaccctttactagagaacatagatttgacaggttcctgtgcatgtactatagcaacttatagcgtggatgggtccttgatacaacaaaagttgctatagctcgggctctcgtgctttcgcatgtatcgcacgtcgtccgtggcctatgacgcacgtgcttgaactcgttccggggtcttctctccgttgctccacggacaagaggcagccagcaaaatcatacgattgtggccggattagacggttaagttcgcttacctaagccccatccactacttcacagagttgagtttggcaggggtctgggagttgctccctgtgtttgttcttctcgtatgtcctggtgcctgtagctacatacataaagggcacggcttgcaggggcttgcagagccggtacaggcaggaaaaataaaagggagattagacaaggccggagctagacggggaaggctaagggtggggcaagacagacaaacagctacagtacaagtagactgcggctatgttttgatatggcgggggcttggccaatactagctgcggtggatacgacgggatctgtaattcgcgcagttcatgttactgggcttgggaaaggcaagccagctcgactgccgttcgctttttcacgctcgccacagcgaagcattgcgttttatccgttgcctttcattgtatttgcggctctcctgtctgcagggaagcaagggatgtggtgatcgacatgttgtcagagatctacacgagctaatgtggggatcgccacgatgatcgtcgacatcttggcgtcacgtgatggaccctgcggaagaccaattgcactaattggttttgctttactcctggcattggtcgtgctgccccattgcctcttttgtacaggacgaggggagctcttgtgggccagtagtctgaagctagcccacaaagcgggctttcttgtgacacggtttcgccgaaagtcgtctggctttggattttgtggcctgccgccggctttccagccagtctttattttcgcagggtattttctgcaccttccatctctcttggtctgagacaggggtgtatgtatagcagtattttttggagtcagcagatcaagccatgtggggtaacggtagcgactctgtgtggacagagagaattgctagagagaaaataaaaacagatatgggattctggcggccggaatagttgatttatcccttcaattttgcaataccgccgttccatcgtcttaaaacacaacacccacccgtagacagacttttaactcgcctgacatagtgtggttttagctcggtccattttgccggatgctaaaaggctactaccggtagccagatggcggtgataagtgtgtgtataatgggaggtgattgagaccaagggtcaacagaattttcagtggagaaggtcagatctatatgtatgcgtgtgcgggtgtataccggctctgcggtcgccaatttgacctacaaccggttcgtttcgtctcaccgattccccacacccttgtcaagctttatatctccagacgcagctctaacagggaggggtcaggtagttttgacccatcatccaggccttggtagaaagacacaagtgtagtgcgagagacgttgtttttctccgactacttttccactaaggctatacctcttctctcagctcggcatccagctctcttctctgcctcccacaaccatacgccgcactgcgtattggcacactgcgaacgagacataacagtgagagagacgcaccacagtcagagacattacgacgacatctacaacacatcagcacaccgacagactcccgttccacggaaatagacgggcggacaggaacacaagcggctctagttgcacacacacacacacacacacacacacacacacaagtctgctcacacgagacaccagttgaccaccggtttcacacgcaccgatcatcggctatcactcatacgactgtcgcccaaaataccccaccatgggagtctctaaaacacatccgccaatgcccacgctcaaggactcgtacacgctgtgggccaaccagatggcggtcagcacgccgtcgtcgccgccacagcaaaacagcgtctttggccagggcagtgactcgtcgctgaggtcgactctgggcctgcgcaaacggcgggacaagcgagcgtccgtatcgtcgctgtcgtcgcccacccgctccatgtcggtgcgccggaccgcgagcgcctccatgggccctccgtcaatctcaaacgggactaatggcactcttcatccctcgcctccaaagcgtaacgcctcactgcatattgccaaagttaaatctgcttcagacgacaacactgtgaacggaacctctctgccaggctacctccaaaactccgcatcccacgcccgggtgccgtccaactcgtcgttcaacttttcccagcactcgcgcaccccgtcagacgtgtttgcgccagaccacatttcgctccaccaaaagactgacagcatgtcgtccaacgacctggacacgctagagcagctggtccagccagacctgtccatgccagaaaaggccaccgcgtcgctggaccagctctacaacatgctggccgagcgcaccgtgcagctctcacacaactcgtaccaaaacacccagctgtgggctatggtcaataagcaacggcagatgattctggacctgcaacgggacctcgacagctcgctggaagtgaacgcccgatacaagcggaggcttctgagagccacgggagagcgagacagcacaaacgccaccgccagcaaagacaccagctcaacaaacgccaccacaaacgcgtcacctccccctacagcaaccaacacatccacaggtaactccatccctgggaatgcctccagtaccgcaaacggcagtgtaactaccgtggttccaaccactgccgccacatcggccgtgtcatcttctctgccaccacaatctgacgacaataattccactactgccacctctgcaaagagcgccgtaagctccaccccttcgcccaacggatcgacatcctctgtcgccacatccatcaacaacaccagcgccggcagtaacaatggaggcgcaaccacagctgcctccaagcacattccccaacccatcgtgcccctgccctaccccttgccagcagtctcgtcggctagagaacccaagggcttttcgtttgaggaggaccgcgacaacagcaagacgcaccgcaagaccaaatcagacacgctcaatgatgactcatttctggtaccggaaaagtcgccgtctcgagacccccgtctgcgctccaaaaagagcatggcctccgtcgtgtcttctgacgacaacaccctaggcgccgtgtccatgtctaaatctgcatctatgggtgcggcggctgctcccactactccgtcgctaccccctcctgcgctggctcccgaacctatcactctgtacgtcaagcccacagagttgtctacgattcgtgtggatgtggcctcctcactaggtgtggcccgcaagaaggacaccccagtggtcgtgctgtctgtgtcggacagagccacttcgaaggttttatggcgatgcagcaaggaatataatgcctttgttgctctggacaatgccattgctccccagattccatccttcaaaacgaaaatccctgaccggtcgctcttcacgtcacacgcccccgctagagtcgatattcgaaaggatcagctcaatggctggtttggttcgctgttggctattcccaggctgccttcttctgctgctcagacactgtgcgagtttctgtctactaacaccatcgaccctctggatgtgcctgatggagatgcccgtaaggagggcttcctcactaaacgaggcaagtcgtttggtggctggaaactgcggtactttgtgctggatggacccatgctcaactactatgagtcgcccaacgggccccatcttggtgctattcggctctacaatgcccgaatcggacggcaaacacaggaagaggactccaactccgaggacgcgtaccgacatgcctttctggtcatggagccccgcaagaaggactatgttcggcacgtgctgtgtgctgaaaacgaccgcgagcgagatgactggattgaggcgcttcttgagtttgtgacgctgcccgagccggagtcgcccatcaagtccattcattcaccagccatcaccaccgtccccaccaacaccagcactctcaacgcctacggagaatccatctacgatgagtattctgaggcccccacccccacgcttcccacaactgaggctattgattctgtcatggagtcacaaataggcactggtctgggtattgatgtcggtagcagtgagactgttggtagtggtaatggcagtggaacacgcatcaacaccggttctggggtggttactagctcttcgaacagccgcatttcagcccccattgcgtcggagcccatccagaacctgcagaagtggggttacaaatactcgccgtcttcccagtcgctcaacgcacaactccagaacgacggaatcgacgaccacgtgagtctctcccccaaccacaatatacactctactcctatccaggctcccgttcccgaggtcaaagagaagaagaagttcttcctgttccgaaagggaaactcggaccgccagcatcagcagcaacagcagcacacgtcgacacccgagtacctgcagtcggtgcttgaggctgagggcatgattcaacgtgaggagcgacctaccaccccgtcgctcaccacgcccacacagtcgcagttcgacggcaatgactaccaccagggtggcgtgtttggagttcccttgctgcaggcgattgagtcgtctagcaaggatattgacggccatgtagtgccgtcggttgtctggcgatgcatccaatacctggacgatcagaaagcgcatttcgaagaaggtattttccgactctccggttcagcatccgccattcgaattctcaaggcccgcttcaacgaccattacgacattgatttggtgtcggattcgtcgacggtgtttgatgtacatgcagtagccggtctactgaaactgtttctgcgggagatgccgtctctgattctgacgcagcagctgtcgccggcgttccgacgggccatggagattccggacatcgtgaatcgaatctacgagctcaaaacgctcgtcaagcagctccccgccgagtcgcgtgacctgctgtttgtgctggcacagtatctgtgcaagatcatcgagcaccaggattacaacaagatgaacctgcgcaacgtcggaatcgtcttttcgccaacggttaacgtgcccgctggcattttcgtgctgttcctcacagactttgattgcattttcggagacgctcagccccgcacggacattaatagaaagttgcaggactttccacaggctttattgggttaattaattgataatgatggtattgatgtattgtaattgctagaacaaagtacttgtaggagtatatatatgtgcactacatgtgcttgctagtttttcccactactcgtagttattagggcctcgttttatatatcgtacaagtatatatggtgagtatcagacagcagctgtagtcatattacaagcagttacaagtacaagtgcgtactgtacagtacagtatgtgctgtagtgtgtactcgtactctcaatctcgagaataataaatttattagtacagaagtttcctccaccaaattatgttgcgcggtataatgccggttaataacgccaaaagataccaaccaaacggttgcagttaactagcgatgttaactcaacgaacttatcctgatgtccccactcgcgctacagtacttgcagcatccttatttacgtccgccaatagcaaggttgtcctgctcgtacagatccttgacctcgccgaaaatctttagcagacgggaagcgttggactcgttcttcttcttggcgagatcgttgtagtgctgcttcttggactcgggaagagcggaccactcggcgatcgtggacttgagcttgttgtcctccaagactcgagtctggtccttgagtgcctctgccaggtacacgttgagaccggacagcttggggtatctgatggtcttgtagtcgtacttatcgtacacattgccctcttcagaggcgtcggggccgtattgtctagcaatctcagccttctcagagtcggacatagcggagtaccgcttggcaagctcgggcaacttggtaccagggttctccttggactcggacttgagccaagcggtgtaagggggaagacggtctcggttggagttgtagaggatatgtcgtcgcagaagtcgcacgcggtccatgttgagggtgtcggcctccgtctcgaaaagtcgggtcatctcggtcttgttgagcttgccgtatttgcctcggtcctccttggtagccttgtagggagtcaccttgggggccttcttagcagccttcttggcagtcgtgggagccttagccttggatgccttggtcttagtggcagcctccttgaagagcgccgagaatgtagagaagggtcgggcgaatttcactgggttaacatgggaaagaatgaagatggtagaagagtcagttgttcaatgcgtggcacagaaatagcaatgatactggttgaggcagttgcaggagacacagacaagtcgatggtcctgaaggtgatcacaccgatgaacaaacggtcataactagttgaaaagtaccttaatcgacgcgtcagatgaatgtatcatgttcagattcatgctcgggctcaacgttagcttcagcacgtagcctacactccagaatcaaatggttcctttcatctctgcactgtctcaattgtcacaatgtgagtagatgaggccacaacgtgttccaagtggcaaagaaccacatctagcagcctccaaggttcaattactaccgccagttgcctttagctgtcgtacaccagatactgcaaccgagtgaagcaacagtggttcataacttgccccgtatcatgctttcaacctctattaccacgtaacaaccaagtcgcagatatcgcacaatccggtttagtgcagctttctgcagtgttcgcggcagctccatccatctccaatagtactcactcatcttgtgtgtgttgtgttggtaaagaaagagcacactggagcagttcagcccaatgtttttggtttgtgataccctaaccccctgcctgcagctggtcgaacggggggagagggcgtgatgagcgcgttcgagagagattgggatatggaagaaagaatggtttggttggatagctcctcttgtgagatttaagtctttatattctcactgtatatattccccatccggtatgatactatttctttggtgtttggtctgccagttgaggcattgtctattcaacctaaaatccccactgcgtgggtctcgatgtttgattacgaatatgagatgcacagcaattgaaaatgcgaagagtaacggagcaaaagtgagccctcgaatcacagtggagtacgaaggcttgctactggggaagttcggacataaaattgatgtaaattgacggagaattggccgattgaaatgctggtgggactggagaaaccgccttgagcagagctacacgtgggtatcgcccaatcatcgtgtccacaacaacattgggcattttgagagtcttcaaacccacattttattatgaaacagctactttacaatactggtattctcgcacgagtggtcacgcgattctactaatagcacggagtttatttgctgtttcaaactgtgtcgtcttcgacgtgaagtgggtggaggggagaatggtgttggttggagcgttgtgtggcgtattgatgctccaccgactgattttttgctttggggtgtttttctgagccagaaatgccgtccgggttgtccaaacaacagctttagttggccagtgttatatttggggttcggtgtttagttgctgagtattggcgtcgttcttttgttgagctacagtatttagttaagtccagtcttcttttgttaaatagttgagttgcggttttgtttagttgttgagagaagctactgtaagtgaacagaaccttcaaaagcagctgctgaaccccaaatgtgtgtttgaatactgtaacgacgtacaactcacgtcaaaggatgtaacgtactgtaccaaaactagcgacttcctggtgggcacttggtccacatcagaaagagcccccaaaacactccaatcagtcaccaccaacatgttttggttactccgctacaagtagctgttaaaacaaccaacaattgtagaaattggaagcacgtttcttcttcaacttcatgagcaccatctacgacgaccaatggtatattgcgtacagtatgtactgtaccagggcctggcagctctatgttgacgacaattgattgtttagcatacattccagagtttgtcaaactgctgaacacagtcctttgaacctcagacgcaataataatgaagttcctgagccaataaaatatgattaatgaaacatctgtatgcttcggctgctatctgtctacctccatcgtcacatgagagtagggaaccacctcaatcttccaagctaagtactgacccataactacttacatttatttcaatacgatcctccccccagctatggtcttctggttgttggccagaagggtcggggggtggcatcgtcgatctcctgttttcagaaaatatctgagctacaaacgtgatgtcgcagtttgggagtctcggaagccctcgggaggcgaatgaagaaggcaactgagtcttcaaaatatgtttgttctttacccctctgcctatttatgtattcgataatttcttgtctctgcctcgagcattctatctctttgccaggcttgtagcagtccctcattatagcataccctcggttggagggtcaattcagctatcacctccagtcactcacttcatcttgaattggtttctctttactgtaattcctttcttgagtttttatgtcacttctgccgacgtcactggcaacccaggtctctgaaacagctttcgtaccctcaagccccatccccatgccgatgttttggttgaccagctcaagatatatgctgatggtacatcccacgaagaggagaatctctgtatacgtaggatatatcctagagttcactgtgatcattgcccaaggtcactcctgcccagattgttgctgacctcgccctgaaccacaactttgccaagtacaaatatgtcttgacctatggaccccagaattgatgggaagccatgtttgtagacaacgtccggagaatttatgaggccttggactggcgtctcatcttccttgaggctcctcctcaaaacgctcaaaagtacggatctgacatgaacgcagtctatcgactttgggattcccaggaggttgcttggttcaaagaagagcaagacggcgttcaaatgattatccattggcctccgtcagtttcgtgtcagcaggctcgaactgcaattgaagtacccatttgcaatacccacctctgcttatgtttcggagactacttcggggactgctaggactgatcctgccttaaattcagattcagcttctaacccagccccttcctctactcatacggagactcagctacttcgtctgaagactctagttccaacagccgatctccttcttctacatcagtctttgatacttctctctccgccacttccgcgtctagtgttcccgtgtcaagtgctccctctttctacgacagccgggtccacctcacgcaattccacagcttcctggtcaagtctttcaacccaatctagcatcattgtaaccccaacatcagctggatcttcaattagttcaaacgctactgattctatctccgacgcttccggtgatgtttgtgattgttccgactccggcaacgtttccaacggttctgaaatttctgcttctaatggccagcaaaccggtggtatatctggtgtctctaacaaggcttcaagcggcttcaattaactcgccttccgactccaattcgttcttgaactatcaccagcctcgacaagaaactgtataatactgctcccgcaggctctccggccttggtatcaatccacggagaggtcgaactcgcaaacgtgcaccaaaacctgtcgacgtccgatgggatgtgaatcatcacgcgcgttgacatactataccggcaatagaacaatacactcaagcagatgatatttgataccagtacatgaacgacctccctgaatctatatgacacaaaaatttatccatttttttcacacctttcctgtttctgcctacctcaacccgcttccaaaaaaaaaaaaaaaaaaaaaaaaaaaaaacacttctattgatgcatgcttgatgcatgaataatgcacaaacgacattatcagcgtatctcaatctttttcttccccttacaccgaaactgggtgataaacgacattctgaccgcaattaggacgaaaacgggatccactaggccccctgacttgtctgttattgtatatacagctcccttgcttccgggtgacccaaactgccctcctccaccgactctgagtcgcgaaagcagagccttaggtcacgtttctggccaccaaaccacgtttccataactatcactgcgtcatatttccaacatatctctgacgaccaacctaacggatgtgcgattcatacgtcagctacagtgcgccatttacgggtacgaggacatcacgacctgcggtctcgtggcggtcttcaagaactcgtttgctgttaacaggtctgtaggctcattgttcggcagagcgagtttcatgctgtttgcacttggaggagtggagctggccaaaagagatgaacagggttttttgctgtacagagatgggggcgggttgtttgacgttcctccgggctgcgggcggggtctcgacgcaacgttgccaactctgaagctgagctgggagtggtggctgtgaaggactcatatggtgaattaactacgactggggggggttctagagtggtagcaaaccctttgtcgctcatcttaagcattgaactcgtggatggcacctctagacaccatattgacgatctgcatctcaacgacatcacctttggaagagtccaaactgctgcccatgtgaagcaacagcagaacaacgactgggctcatgtggttaacgtgaacaaagggatcgccaacttctccgaagttgttccccagcctgcacgtgagttcccatttgagctagagacgttcgaaaaggaagccgtgtaccatctagaccagttagactaagtatttgttgctgccaacacttctaccggcaaaactgacatttccaagtccgtcatgggctcaacgaaacatcacaatcaccatctacacctatcaagggtctgtcagacttcaacgcttagtttgacgacgttgaattctcactggggaagttcagatcaacccctaggcgtcttctttgattatgacgaccggtattctccatatgatgctctatcgaggtgctcagctgatccgagaggtggaaatacattatgtcaacgatgctgatcgaggagtagtatgtgaggaagtgatcaccatacaacccgagcgtaagttcatcgtacaaagcagaaggacatttatgacattcattagtacagtacgcccaaacagtctaatcctttggttcactatcttcaatacaacaacaagatgttgagattgtggataagaacaacaccttcgtcgaggatggatacaaccaggcaatgcgagtgaggagtaacctcccccatccccccgcctactggccctgtagcttataggggatatcaaggaggtagggtaggaaaagaggtcggggaggtggacgaggagaatttcctgggagactttcctcgggttctccttttcccacgaagaaagcattcacccagatggttacagtgttgcatgataaagatctctatcaaatgtgcacgtccgtcttttcgcgaaaaatgtgtgagcagtttctgggtacagtacctctctgggctcgatttctacaacaaccatgagaagaccaaaatcaaaatgctcttcgatgagattgttacacgatggtctcatgtcgacagaaatctgccccagattgtgccgatgtgggcatatctgtctctgagtgtcgctgttcaccatgtcgagtttgctgcctattgtaaaggaggttgtcaagattctgtttgccaggtctctctattgtgttctgtttgccactgagatgtttgcagcggatctcaacttgcccactcgaactgcatttgccagatgtctaaagcgcgatggtaacagtttcgaaacccttcttccccgagagtatactcagatggctggttgagctgttcgacgaggtcttgacaagacaggaacggtcttcattatggtttctggagaggtcacgccagaaaattatctcaaggatatgatgctgggtgagcacactaaactggagtcttaattccgtctcacctacaggattctgaatctattgctaattgaggccctcaaggtggaagagatgatcaagcggtctttttcggagaactccaaccagctcatgcttccatagcacgaagcctgagtcaaggtctcgaagacctgcttaccaatctcaagaagaagaaatacactgattgtgaccagtttatgccattttctcttgaaattgaccttaagcaactggtcctgttcaagttcatccttgagcaaggcttcaaggtatagaacatgcgagacatgctgaagattggccgcattgttatcatcagagacacgtggtctttctgcggatcgaattttcggaccttggtgaaacagcctccatcctaatgtttcccaacaccacatgtctgctggcaaggatagctgcctcccttgccatgttcccaccggtggttggataccacaggtttttgctcgctctacttactccgacctcagaaaagccggagactgggtctgtgccctggtataatcttgcctaaaacctattccggcacatcatcggcaatttgcgtgaagtggttcggtttgaccgattaagacgttcaacaacattgctcagatttagggaggtcacattagtacagtaaatcagcacagtagatgaggtgaatcggacctagccactgctctcggtaatttaacaattgtctacttcttcccaagccggcatctgcggaagaaattttgtctttggtgacattgtcatgacatgattacttcggcctcagggagggagacgctttaccacgacttcccatgctgatgttgagaggggtttacagatgaaaagtagaatctctagagtgaagagtcgagtctgttgcatcatccgacccgtatgtacgtagttgcaaaaaacaccccagacttcgcctccatcactcaactagctttttgaaactgctactactgcctctaccggggtagaactaccactcagttcagacgttatatcaatctttgaagctcaaaaaacattttccccaaatccccaaacctgtagatcatttattccattcaggatatctcctcaacccccctacccgtttgggtcatggctgcttcagtgggcattatcaatgcataacaagacaagggtgtgtatcacacgactccacttgtaaaataatcaatataataaatccatgtttcaaatatccacgcaactctatgaatgaggagctcgatagcatcattccgttgtttagccctgtcttcagtgtggcttactggtggagtagttgccatgttacagtctgtgaatatatacaatgcagtaaaagtagtaagtatcgagcaagtatcgagttgaactacaacaagatcactaacacaacagtctctacaagaatatatattacaaggtcataattatacattataaataaagaaagaagtgaatctaaagggatatcgtaagaatgtaagagaagcgaagtccactaagtggattagttgaaggccagctcggcaacggcaccggggtgcttgccgtgcttgccagagagaccctcaatggcgagagtcacgtatcgagcagtggcgttgtgcagctggaccttggagacatcaccaccgatggtagagttctgggcaagcactcgagactcaacagagaagttggagtaggtggtgttggcccagttgagggttccgttggccacgggaagaactccaatggagtagttcttgggggtgaagggtccccagacaatggtggcctcagaaataggtcgctctcggccaagatcaatcacgacttcggatcgagaagcgttgatgggctgccagtaggtggcgttgtcaccgtcgttgatggagacggggaatcgagcagggtgccactcctccttggaagaaacaggagcgttctcagccacgttaccgggaatgttcttgaagtagatgtcgcctcggtaagtggggatgatgagggtctggttaaccttgatggagtagttgccagcagcagagtttcggccaccgatctggatgaagacaggggtagaatcggtgctgtcctgagcagagaccagagtctcgttggaagcgttgtagaggccggaaggcagctcccagaaaacgggcagagaggtctcgttgctggaaccgaaagaagtggcgttgaagaaagtgccgttgaaagaggtggcgttggcgaagcccaggttggtcacgttgagagtgtgggcgttgccgagagtcacgttagacacgttaagaccgccccaaacagtcacgttgagatcgccaaaggtgacgttctgcagagacgagaagttgaagtagccgaaagaggtgttgttgacagtgaagttggacacggtcaggttggcaccaagagcagtccagttgaaagcaggcagagtagagacgttaaggccggtgaagttggcaaaggcagtagcgtcgtacagagtggtgttggtggcgttgaacttggtgccgttggcgaagaaggtaccgttgccaaaagtggcgttgccagtagacagagtctcaattcctcgtcgggtgatgtaagtgtaggtgccggtcacgttgatgtcgtagacctcgccctggtacttgaagcccttaacagcgtaaccctcgggaagctgaggaggaagagcagggtcgatgaacagggtgtcctgagtaggtcggaaaccagtgaaaccgtgggtgaagatctgcaggaaagcgccagcaccggggaggtaagggaaggcaccctggggcttctcctgtgcggagaactggtagtaaggctttcggaggaagggctgagaggcctgcagaaggtaggtgtaggatccagaaccagactcggatagggcagcagagtcaatggcaagcagagaggcgtccacaggagacagcttcttcttctcaacctgcttggagtagtggtggaagttagccagagctcgagagtgggcagcagactcggcgtcgtagaccagagggtaagtcagggcgttgacaccgagggtgaggttgccaaggttggaagagggcagagtgatgttcttggaagactgaggaatgtagacattctcggagatatcggaccaggtagggttggggtcctcaccgacaatatcggaagcagcagaggcagccttgaacagggtcacggctccagcgttaacgtaagcagagtcaagcactgtcacgcccttgtaggtaacgttggaggagtaggcaccgacagaagagttcagagagaactgctgggcatagtggttggcagcagcagcaatgaagtcgtagccggtggagttgagccactcggtgttgttggtggacacaaagtagttccaggcattcagagcagagtcaatggaggtgtggtagggctcaacgagagatcgcttggacttggaagagaccttgttggcgagaccgactcggtagttgacaacgttcttggcgaactgagggtagagggctaggagagcgggggagacagtagagtcaatggcagcggggagaccctggaggttggaagaagacagacctccgacagcaatgccgttggcgttgtatcccttgggctcgtcaccagatcgcacggaagacaggaggtggaacagagaagccttgacagcaatctgcagctcctcgtctccaggcacaacaatgtcaccgtcgttccagatgttgttccaggcgttggagtgctcgtaaaggagggtatcgaagccgagagctcgggcaaccagagcagcctttcgggcagtggcaaaggtggcgggagaagcatcggaggaggcaataccaacgtacttgatcacggtgaaggtggtgttgggggacagctcgacgggcacagactgagagatagactgggtggagttggcctcggtggaaatgttgacggaggagtagttggagaatccgagggtggagtactcaaacacagtgttgttggagccgagggcagacacggcggtccagatggagccggtgtcggagccggaggcgaggtaggaggtaccgacagatcccttggagttgagcaggtcggtgatgttgacagtggtagcgttctgggaagtgatatcaagtcgaacaataccgacgttaggtcgggctcgatgagccaggacggtgtagttaagctgcagctgggtatcgttggtgggggaccaggtgacgttggtggagaccacaccgttctgcagagacagggactgggagtagttggagatgtgcttctcggaggtggagccgttgtagctctggtttccgacagaaacagacagctcggaccagttgggaatggaggccaggaatccctcggtagcaagagagccgttgccagcagagtgggcggtgaagccagacacgtaggcgccagtgaaccgtcggtcctcaatcagagaggtgtagttggtggcgttgccgctctgagagaagccctggccctggacgggcagacggatgccgatgaagccgttggcaacgtaagcttccgactggtagtttttgtcgaacttgtgcgaggtcagaacattagtcttgttgttgtactcgagagcagtctcgttgtactcggtgcccttggtcacgttgacggggccggggacaggcagaaagacggggcctcgagaagcagcagtagcagaggtgttagcgagaggagccacagaggtgacattggcactggtggtgttgacgggggcagccagaaccgaagaggcggccagcagaaggccaaacgaaaagtgcatgttggctacgggagggctggaagcgtaatgtcttttttggggaccttaccccccagcagaccacctaccctatatatcagcgctgttggagtgtgaccacccggaggtcacttgcttttgcgaatctaaaagtttggctttagattaatccctcgggtgcattaaacctgcacgcgctacagaagaggtaatcctttgtctcttttcggtgaggcatttgagagcgctgtatgggtggcgatggggggatgaagaaatggctgaaatctggcaaaatattggtaaaactgaccgcatttttctcatattagtcgtggtttttcctatttttcacgtcttctcctcctaacacaacccacattcctctataaacttaaattttcacatagcaatcctcattccgatccaattctggtcatattgcaataaaagtaccactgttctgctcgtcccacctggccgagtcgattgatgcacttttttttcctcctacatcccatatttagcctaatatccccacatcctcagtcacaaactcacgcaaccatggcccgattgcggagatattgcgtcttgcatggaaacgagagtctacagtgttgctggagaaataaaatcgactttttggacccaacaaaaccgccctaacaggaccctgcctatgttattgtgactctgctagccctctcgacgttgcaccaggtgctccactaattttgcttattttcccgccattttatccctgtttttccgaattatcccgctgtttttccgtccctcagctccgccaaaaatgtttctttttgttgcgtcctccgaaaaaacaaaaagagcgctttgctgaaaaaaacacaggcgtagccgaacaaaatgctgtaggcgaaccctgtacagtcgctgcgccgagaattacttaggaaccagaaatgggaaaattaattgaaatataccaccagagtcgcctccgtcacgtgagcccactgatgtactagttttgcgcctgtcgcaaatattgggctgactaatccacttctccgcaggcagccaaccaacgatccaataactaatatccgactgcccgtttaggaatcaataaagaagatcgacaatgcgttttgggaaatgccccgttggttgcggttggggaaggggtggaaaacttgcctatgtagagcattgtggggtttggatgaataaaaaatacactgttgagtagctactggagagacggttgctacaatctatgagatattcaaattgagcatgtacagcccaagtaatgtctgttctcgagcgaaccctaagctgcagcagcccgaagactgcacgggaaatgggtcaaaaaagaatcaaaaagatttgtctgtgtagtcaatcccaaagccgtcagactcacgattctggtgtgcgcatcttttgagcctttcccaatcaggcatgtcgattggctctgttttcagccctgtacccccgatcgtattcgctagacattgctatttggataggtgatattttgtgggctctggacccgagtaaaggcttgacggttggattgggcccgtcgagacggttccaacggtgggacgggcactgccattgctgcggtttgtggcgttttaccgcggcttctaagttcgtctgccgcactcctccacgtgagggggttctgtagtcagacaagggcgtattggagagaccagatagaaataagggttttgtgggtacagtagcgatgttttgcggttttcgcccgttgtaatattcgacatgtctgccgtgttgcaacagacccgatttttctgtgattttctcagaatacttttttgaaaagcccggtaacgcggaaattcggaatatcggagctttggctgccaaacgccgttagtcacaatgaactacaatatagcttgagccaaccctgagggatattgtgagtttaaccgctactgtatagaatcactaagttggtgagctcattgctgcgaagtatattgaaattatattgtcttggagctgaaatttgaggttggaaatttcaactacaaatatctggggagagatggaagatggggcttttagagacactaccgaagagttagatgagacagctgatcccgggacccttccaaggcttctagtttgtctgtcgtggagctctacatgttctctcatcggaactcctccacccaattacactatcacccacatctgctagcctgaaaagttcaatatatgcccctgaattcgcttgagcacatagtacaggcaatgtagctatctccactgccattaaggcgacccagccacgcaatatgatgctcgcaaacccactcaaagtacgctcaaagttatccctgagtgagacgttgctaacaaatacctcagacgttggggatagaataacggtcagctgatgactaaatcactcagggcggagtgggccgcggctcaggcgtttgaggagccaatgttagagtgcttgtagttttgaggcacctacgatatatactaagaaggcaccgctgcagttacacactcgcattcgatacgaggcctgtctctgcctgacccatgcgtatccatcggggggcgtggacctgagatcgaaatcccggcgctctgaaggactgtaacagcaactctacagtattatttactgtacttcataatacagtcgtgaattgagagtccggggggaataggggttggattagacaggtttgtgtcttgccatagacggagacccagatccttcggggcaatggcgagagatggaacgtttttcatttatcgccgaacgtatctctccacaattgctacaagtacatacagtacatacggtacttttgttaaccagctccgccacagctcagcttcactaactccacgtgaccactatacaggcaacaactcggaaagacaaagactaaagcaaacttttcaccgcgagccgtccatttctcgatccttgcctcttggctcggtgcagtgccgttttcacagtcaaaacattgttgacacccctgacagcctcgcttgcaaccagctatgtgaatgtactcggatgtagagttgaagcaacaatgtacagctaccatgtgcgttcaggacgtattgtgcgagacagaagacagaataccgaaggtagtgggatgttgtccgtacagcactggcttttaggagcccgagtatgtatgtattggaaaacaagttaattgctatttgtgcacctactactggtctaaccgaaaaacggatagtaccaaaagactcctttcgtctaggcgaattccgcaaaagcccttctacgtcacgtcacccaactactggcaaatccacagcggtcaacgtcccctcctcaaactcagccaggattcccaaatcgagaaataagctcgccactgcgcccatttggtcatgcacagatgcaatataaaagactaaccttgcgccgagaagcccaaacgggaaccaaggttcggaagcaaacaaagacggtcacgtgagtaaacagagttgctgaggcaacccctcgagaatggggaggctgaatgtgataaaattcgctttactgaaaccccccagccgtgagcttgtcgggtacactagaaatccaactcacgctaccagaaaatccaccagtcgtgttcgtctggttgataatcctttgtctgtacttatcacgtgtggggcggagtttaacggagttattggaagtttattctccgctgcggttgctacgaggcggaatttcgagtttgggaagttggtgtatttttgaaatgtctcacgcgaattctgaaaagtgcattttgtagctgccgaagagaggagtctggctgtagctttttcttgccggttgggtcgatattcgtggaattggaccgactataagttttattttggatacggtcgactctgggaacaataaaagtggaattcgtggttgaaatcgggctaattggggtctaaaatcagatcccacgtggtctccgacggtgagaaaggagtctgaaatatctccggaaaagcagacacactccatacagtatacatgtgccgtttagcgaacacaagatcgacgtcatgtgaccagcaggaggttcagtcaagaatgtgcatttagttagggtttacttggtggaatgtttagtagcgcataatctgagaaggtggttgaaattggtattgaagagttgaggacacgtggagttttgttcaactgaaaaggaattatcaatggaccggattggcgagctggcttctgtgtattgtgtttctcggtttgtgtgagtacagcacataccagtttcgtacaatacataggattgtatgtacttgtagccatggacatctgtgtaggaccaagagtatcaaaaaatcggattcatatattttgagaagaatcactaacaatttgatgttctaacgatatcttttggtccatgattttgtagcccagagccgtataaatgtttttttttttttctgcatatacattcatttaattataactttgctgtgaaagaataacctttgaaatgaatggtatcctagagggttctaaaaatctatgtaaagttgcaacttacttgggtcatttagtggtagttagtcaagatttggaagtctacacgagctgcctacgagctgcctatgagctgcctacgagttgcctatataacgcatttcctttcggatagatactaaggtatttttccaagacttctatattcttttgatttgattcccattctacctgagcctctgtagtcgtcggtactcccgcagtcctcgtcatgagcactaatagttgacaggaggtggcatattccattagatgactcaatttaacaattggaaagccttcatgggtctcgaaataccttcagtatttatctacacaatcaccacaagacgttccaagcgcagttttctacaatctgagtttagccagggttagtcagggttagcatcagttagaagaggtgaagaggcgaattcttctcagattcttttgacgacttccaaagatgatcaattataacattgtgatcattctgtcctcgtcagtgagtgatagattgaacattgacactgtgctttatgcttagcagtaagaacaacctgatagcacagtacagagacggaagctccggcccttctttcgatggcactattctctcctgtggttacgaatgctcatcttcatctcagacaagtactaggcgacagctaaggtccatcagtcactagatacttggtaatccagactgggttgtgcttacatgacagcacaacagccatctaaaagaacagtccctagaggttgttatcacaacagtcctctcaattgaacttcattggagcctgagacaaaaggagcgccccttgggacagccatgacgtgctcactacactgaaaaagagtatacatgggtacaagtacttatcacatatcatcagctgatgtctgatagtgacctattggttcctctggtaaactacaccgtttactgtagatatgctatactcctgtgtatatatcatcagtgacataccttgaggatttgcgatccgtttaccggtactcctaccacggttgtttctcaacaatcacaatgtatggaatacagcaataaaaacaatacagtaatagtacattatctgatctgctctagttaagctgaaaatctgcgttttttattattctaatgactctttacagctatatatctagtaagccgtgttattggcgttccataaatcgtacacatgacaatcgtcgcaatgatcgtttcggtgcgcgtgttgatgggttcgagactgccaatgtcgttgtcgcttcgtcttgttcttgtagtggtcacgtggtattcttttattctaaggattcacgtgacttacttccccagtagtatagtttcaacgacggattgcgccagttgcggccatatcctggtgaaaatacggcttcccgtccgatcagccatagtcaagcaccagagagcctagttagtattgtagtgggagaccatacgagaatcctaggtgctgcaattatttttccaccaaagcacaggcggttttttatttttgcatattcatgttctgactccaacctggctgtatacttcctgaccagatactaatgtagagactacagtgtcatcttctataaagctcgggaaatccaatttttgtaaccagagagttgctgtacaatgtaaaagggacacaaagaaagcacgacattcaatcacccgctctgagtggctcgtttcaaaacatcctttagtatccaaaaatctttcactccgaggcaaataagctcgtcgtttatgcaagataaaaaaaccgcttgagaagagcaatacaggaggtactaatattgcaggaagttgatttcggagttctgttaattaaaggatgtttggttttatcctggagtgttttttcctaaataatatttcatatatccacttccagagacttccacgtccttatctaggtttccgtatatgcacctagatagctggtctgcatatttaaagcactttttgaccgccaatcaacctctttagaactctatagcagctttccagaaatatataagccccccgtaagtcctgtttctttcatcataatcacaccagatcactctgagtcatcctggagacggaaggtgtcttttatacccagctgagaggcacacctagcaagcagacctgtctacaagacagcccagagctctgtctacaacgaggacgttttcatttattgtcgtccgattgatttgtttggggcaatgcaatcaggttccagaactccaagagtcggttaagaagacaatggcacatttatcgcgcgagccgtgtgcaacagcttctggttgggctgagaatccggcgagttcgatgcaaccgcctcagccaagcgtctttaagtctgagccattcgtgtacgcttaaccgccatgagctgaaaagtgccatgagtaaagaacgagtgattatgatgttgaaaaatgtttgagtctccttgcgagagttcctgaggcagcgccagagcagtatcagagccgtataatccagaaccaccgacagagacactcaagggtggaattcctttttagagactcccatcattctcacaggtaaaagttctgttcgagatactccatactcacagggtgaaactcctttgtgaaggtctcatagggtacaattctgttgtgagtgagagccgcccagaactgaagagcaaggatgaaatgccagagctgctgagctgagatgtttacaagctgagacgcctagagcgaagatctgcctcagatgcctgagtcagagctattaagtcccactgaggcgttgagtgccaagtccagagtcacaggagccagggccatagagccgaggccggccagttgctggtaagaagagccagagcacgagccccacactattcaaaaagtaggcagtgaacctctcagccagggacgtaactgatcaaatcagtttatctagttttgagaggagtaggtgagaatccgaacctctaagaacaatgaatcacgaaccacacgtgtgccacccgaatacttcaaggcgtagtgagttgtaagttgtatgttacctgtatgtactgtaacatcattcatttcttatatcgtagcatgctaaactgtacgatagctagtgcttgtagtatctgaaagtaatcaggcaatgttctctacctcatctgatgtaccattctacaattacatacagcacagtccaccactttacaccaagttaccaatgcatgacctcgacgtgaattaatgtcctaacactacttgctgttatcaacaacgacacgaccaacaatcttaccatcaagcatctgctggtaatactcctcgagcttgctcagctcgccgagacggtacttggtcttgacgagaccccgtgcatagaagtcaatggcttcctgagtatccagcttattacccacataactgcccttgatggtgagtcctcgacccacgtggttgagaatgtgactcttgacggtaccgttgggtggcagagcacacagaaccagagtgcctcgggttcgcacgtacagagtggcagcctcgacagccgcgtcctgcacagcaaagttgaccacggcgtgggcgccacctccggtgagcttgtgaatctcagcaatcatgccagcaccactcttggcaaagtcaataaacacctcggctcccagctccttggtgtgggtctccttgtcgtctccagtgtcaatggcaatcacacggaaacccatgcacttggcgtactggacggcgtaggatccgagtcctcctccagctccggtgatcaccacccactcaccggccttgagaccagagttcttgagggcagtgtaggcggtgatgcctgcacacagaacgggtgcaacaccagccagatcgcaagaatcggggattcggggtgcggtggcggccttcacgcaggcgtactgctggaaagagccgtctttgagcagacctgacacgccgggggctacgcagtgctggtcccagccagcagaacagtgctcgcaagtgagacaagagccagaaataaacttgactccggttcggtctccgacctgccatccggtcacctgatcgcccatgcccacaacctctcctgctccctcatgaccgccgaccagcggcatcttggggctgaaccgcagctgctgtgcccaatcacccttccagatggacagatccgagtggcagacaccggaatactgcaccttgacgagcagctcgtccttggcgggagtggggacgggaatgtccttgtacatcaaaggtccgttgacttcctcgaaaacgacggccttttgtgtcttgggaacgtcgctcactgtgttagcattggtatatggggaaatactccctgcggagagctacagaatcaatgcaatgcgatgcacacaagcagggcactgtgcagactgtgatacagggcacgacactctgcgcaattgtttgtgtagcggtcaaagtgaaggtctgggcatctacctctgtgtttcaggagtagtctgggactgtacctatgtgggcaaactcacttgtgatgttattgatgtgaatgtgtttgatgtaatgtgtttgcgtgatgtgctggcaccgtgtaagatgttgtcaagggttgagtgtcgtaaactggtgaatacagacaggtggcataatgggactaccctgacttatataatttcgaggggcatgatgataaggatgtttttctgacggccataatagggttcaagttaagtggggatcaagtgtggggttgacataacaaccacatagaacaggatagagacatattgagagcgagaaaaacggactgtcacatgaatgactgcttatgaacgtcctttactaccaaaaaatcattcttctaggactgaaaatgcgtcttctacagagactcttgtccctcgttggagttactttagcgagccaagtttaataatcagtctactctttgtttgagagtgtgaaataggtgggggtagtaatagaacacaccaatacccgatccagaatctacaacatctatcattaacatcatgtgacaagatactaatagggacccttatagccgctttttacgtcgttcctggccccacaattcgaactttgtatgcttgtagagttgagtaatcatccccatgtctcaaggaagcatgtagcatcagaggagtttcggaggtagctaatgccgtaaatccgttgcgacattcttcagacagccaaataaagaaagccgtgtggaacaagcgcatccacagtgtctgtaagctgtccaatgaaacaatatcagatgttattgacggtagagaggagagtgactataagctgtagttgttggagcgcaacgaagcccaattactatctggaagtgattcgactgctaatagggcagtacgaatcactgtcaagttcacatttatgttctccagtacaatttcgacaaacaattgcaacaattacagcacaccgacgacgcatttaagagccgctaacgccgacagaaaataaagctcattcatatgcaccttacccctctcctttaatatccgaaaatatggagatccattgagggctctagatgagggctattgggatattgcagacggaaatcaacagccataccgtaaaagataagtcttacattatcctcccgttaaaatactgctggctctgaccgtttttgatcgaccgaaatcccgtccaccgttgcaactctattactttaattgaacgtaaaatgaggggtagatcgagagtcttggaagtgtgccagagagctctcggggagttgtggagatgaaagaaagtcttgagaggctgtaggagtagttttattttgtttattttctattttttttgaaaatcataaaacatactttcacaaaccaaacacaccctccatattctgctgcgctagaatggtgtcaaatcgaacgaatgtaggaggactactgtactactgtacacatactttacagtactgtacccatatgtgttcagcatcacaataatatgacatgtagcaactcagaacccatatcggtcttatatcttctttttgaaaggagctagtgatgttccttctaacgagtaggtatgcaagagtttcgatgtgcttaaagaaatgggtatttgagtcgttgaacaccaatgtacatccaatagttcaatctgctactgacttccacacgctcgatatctcaaacagctcgtttttactcaatacttggactatagctggagcagaaaagtcatatcaactacagtatgtatgtacacgtacagtactgtacctgtacgattaggtggcccaaatatattggagatgtggtacgtatcgttattataatacgccgtattgtcctcttactgtacctccaaaattatcccttttgtttccatgattttttcgatatttattctctgtttatcaagaaatgccaacaattcgactgaaaatctacagaaaactcagatatcacagaaaccacagaaatcaatgtaaaatcgacagaaaatacgacaccatcacaacctcttcaagagagtacatatatgtcaacatacaaacacttaaaaatcacccatgacgttccatgttcccctatccacaactctcaatccaacccccccccccccccctccttcacctactcctcttatataaacaacatgaaatccggacgcaattgcacccacgtgacctgattcactaaccacctcaataatcatccgttactgtcatttatacatgtatcaggcacacataaaaactagcataggttagtggtctaaaatagcccacccataagacttgcctggtttatcaaatcgatctcttcctcttacactttactttttgagcttgaaagggcgctacagtcgaatcacgtgactagagacactcccacgtgatcagcatatctgatacccacattcacgtgaccgattgaaacggaagctgaataaaaatcacctttgcacgtgactgacaataccacctctttgaatacgatacgctgtgcacgcactggacgatactgagcgcacttgttggatagtacgcgacatctaggacatcacgtgatcaaacacatcccttcgatatacacacgtgactctctaaacatgcttcaattactcgctgtcacttttttcctctcgggaatcgtcaccactctgcttggaaacgtgtcaccagcaatccagaagctctcctattatggcaaaacccttacccagaagaccaacagtactctggcgcttcccaagccctggttcatccatttctacattttggcggcatttctgggctactattcgctcttcatcgtgtatgacagtttcagcgacaaccacattttgattgatgttctgggactcttggatagcccaatcagtgctaataatatgtttgcaaacggatggacagactggatggacgatttagtgagcaatatcaatgaatggaaattgatttccaccactcatgttcaaaagcccctgactactcttgttcttctgcttctgggtaccattcagggcactcgacgactgtatgagtgtgtgtacgtgatgaagtacaaggtgaagaccggagcatcacgtgttgcagaggaacagaggaagaaaaaagaaggccagactgccgaaatcgagtcacgtgaaagccagatgcttttgacccactatcttgtcggcatggggttctatgtcgcggtcttttgcagtctgtgggcaacaggagttgctggggttcgagatatggaggagtgggactttgactacaactctgtgggtctttctattgctatttctctcttccttgttgcttccacgcttcaatacttgtgtcatgtgcatctatcttctttgatcaagtattccttgccgactttctggcccttcaagatcacagtttgccctcattacacttgcgaagctctcatttacatgagttatattggagtctccctgtctaccggctctactcctaattatgggcttttgttggcccctctctttactcttactgttttgaccaccagtgctaagaactccaaagactggtataagcagaagtttcccgagtataatgtccgatggctcaccattcccggtgtgttgtaggtgaatatgtaattaattgatgacttctccgttgttattgaaacagatattaaccaatggcggtaacatgttcaccttggataagtatgtatgtactagaatcacgaagatcttcaatcaagagaccagtatgtactgtacatgcacatacagaacacaataaacgtacagcaaactgaaagaaggtgtttatgagcttcttctgtaccaatccctctttcacctctgccgtatttccctctctattactcttcccagtacaaatatcagtccgttgttcaatgggatcacctctctcgaccatcttatccgcctccgggattgtccaccaatgcaggactccatcaactagtccaaattctacacatctgtctttgtgggatatctcgtaaacacgctgttccatctgcacacttccttttatgagccaattcccgtatctcatggccctggatgcttcgatcgtggaacatttaaaagccttgtgtagatctctacgctactgcttgttgatgtaacattttacacccatatagggacaatccgtctaaccagattccacccgggctcagttgataggaacagtcacaagggtaagatatccgatgtccatatcgggcagatataccattgtgttagatccgggattctcgagttgcaatgtatagggagccagatcaggctcgtacaggacagagacgctttcaggtgtgaagcagacacgagtagtgtggccatcttcaaagaaaggatgcactttgagcagataattgggcttctagctaacctctgtttctgtgcagtgatgaccaccaccagggagccgaccgatgttgtgtaactcagaaaataccactcattgaaagacgttcgatggacaaatatctcagggcaattacttccaacacccagatgcgactatttaggtagaacttgaggatagtgtgacctcggctgtcgtggatgggtaagtcgaacagagaagagaatgtgacgccgtctccagggaagacagatcaggggttgtgtggattgtagatgtgcagtatgtacagtagtcaagatagagaccgaccataagctgcgacggatctctgaacagaaccacgtgtgctggaacctgttcgttggtgtgggtccgacttttggggatctcagcaggtgtaacatcggcagtgattccatgaagctcttccagtcttttcctccggcgatcaatgttgaatgcctctctaaacccgctgttgagccagggccatccattatacaaaacggtttccgaataagacttcacaatattcctgagtcgccagagaagaacaatagagtcaagaccgcagtggaggcatatctgctcaatgagctcgtccgggggactgtctaggtgggaaggcgatgtcatgaaacattggtgatactgactgtagactcaatatgttaggaagcccgtttatagtgataacgaattcatatcacgataaagggaatggagattgctccgcggacacgagacacattacaggtttactctcaattagtagtaagatacagtagctgattatacagatgtcatctcctcgttcaattactggtggaagtcagagaaagagaattgactcgcattactatagaaacgtataaacgcagtacaattggttatggacagctgaactaccttcagccacggcaccattgccttcttcatatcatgtcgtattatcactcgctctcattacataaccataggtcgtctgtaggacagcttaaggcagcttgaagcccttatcaagggtgtcatcgacactgatgatgacctttccggtggctcgtccactctccagcttctccacggcatccttggcgtttcgcagatcgtacactgagtccacaatgggcttgatcttgccctcctcaatgtactttgcaatctgggccagatccttgccgctggcagcgcaaaaaacagcatcgtacctggtgccgtaccaccaggcaaaccgggaggtcagaaagttgcctgcagcaagcacatacgagagaatgaggccaggctcggtgctgagaatattcttggcactctgagcagtaggcacacctctgagagcaaccacgacaccacccttcttggtgatcatggcatgggcccagggctggtcggaaacgtcgtaggcgaaatccacgtccttgaccacgtcccagaagttggtcttgtggtagtcaatcacctcgtcggctccgagctccttcagaagaggaatcttcttctcggaagcagtggtaatgacgtaggcgccgtagacgtgcttagcgagctggatggcaaaagtaccaactcctccggcgcccttggagatgaagattcgctgaccccgcttcagattaccggcttcaaagctctgcagcacggtaagtccaaccaggggaataccagcggtctcaagaagaggcttgttcttgggcgcaatggctacatgggcgtctcgaacggacacaaagccagccgtggtgccttgctcagactcgccgattcgagcgtacacccgatcgcccttcttgaaggcggtgacagctgtgcctacctctgccacgaagccagcaacgtcataagcaaagatatgggggtgcgagtcgggctggagaagacgcaggtagccccggttacgcagaccgtcgatggggttgagtgcggagttggccacctgaatcagaacatggtcgttggatttgagctgggccaaggagaagttctccgagtactcaatcttgtcgggaccgccgtaggcggtggtgaaagcggcctgcatggtggaattggaggtgcagaagaagatgtgatgaagagcaggagcttctggagatcctagcacccgtaaaaggatggttcaaagttagtgcattatcggtgacagggggtgtgttggatttgagagggttgtgggcactgcggagatctgaaagttggtggggtgggtaaagttgatatgctgatcacgaatctcttgtttaattgtcaatatctgacacaattgggccgatagatccatctgagtgaaatcgagtaggtttgaacaagtgaggcggccaaaccttacgggagtcgatacgtcatccatgcactgtggcggttttgatgtgtgattgagtgcttagtaagaggtgttggtggtgttggcgtaatgatgtttgcaaagggggtttctaatccaccatgaaacactcgtaatctgaggtagttgggtctagatctgtccgatggagatatggtatatagggcacagctgtattggctggtacattgctctgaactctacgatgctattgatgatggcaaaccgcatgctggagaaactgagacgtcattgcaggcacttgagagtgctttgttcgcagtctggtgaagggaaaaccaacttcaatggtggtctatgttctctgagtgaaaaactacaagtacagtgtacagttgctaagttctatcctgttcgtcgtactcttactcgtactgtactaacacagtctgcaattgctatcctgacatctgagtatctccaaacggtggaagagactccttgtgaactcggaaacactgacatgtcacttcggcgaggttcgctctgaggtttctgaatgttggtataatgtatctcgccggttaatctcatttgagatgtccaaagaacttttcattcaagcggtacttgtactgtagcgagaataaatgtcacgtgcaagatatctctcggagacatctaccggcacaatatagcccacagtctctaccctgtcgcttgattgttctcttagagcgaaccaaaatagattgtagctagcgtacaagtggctccagtagtcagggcagacaagtgggaagacatagacgtacttgtaatacgggtgtacggtcacgtgggaaagtctacaagtgctacaagtagtcgtagttcaagtacagggggtccttgcgcagctttggtgtcatagatactgaatttgctgctattacatggagcgggactctacaaagaggtccatacaaagaagtacaagcaccagtacaaatgctagggtggatatgagcatatcgaagtgaagctctcgacgatctggtgtcaattgcacctatgaaaccatacatgtcaatgtgacggaaacggcgcagttatcataactgagaccattgatttaatagacgaattgagatattggaactcacggcttgcaactggtgggctatctactcgtactgcaactcgggtgcgcgttttttgacgctcttgacgctcttcacagtctccacgttctgacaattgaagttgactaatcttcctgcatgtcgtatttctcagaatctgagttgctggagcaaccaccaaatctccccatctcacccgacgcgcgttgctgggcaaccacggcccaattagagaccaatattgtaactttaaaaaaaaagtgtcccgaacgggattttggaaaaccctaaaatacgccacaagaggaggtgacatggaaccaagaaaatcgagcacagagtgaaaaactttggtgtgcaacatgatgagggaaaaaggcggatatggacatgcaggaagaagattggggtaaacctgtgcacaaagaccttgggcacgggcgaatggtggctttcaaatgcgcattactcttgctctcaatgtccttgaccatcgaagtgggactcacgatgttgagtcatggagaaaactccgtgcacctgtgcatgggcttggctctcgctaataacagccttgttaccgaatgtcaacatgcgatggttcgatggggctctctctctctttctggttgtataggtgcgcgctccagctatagtagacttggattgaagctgttgggttgaagctgtttggggagacttagttgggtcgttaaaatacccggatgagaaagtaactggtaaaaagtatctgatgttggttggttgtttggattccatccgagggtctactttttctactttttctacttctactttttctacatcagatctctgagatccgtggaaagtgtctctcggagtgtgcacctatctctaccggcggaaaccgtctggagccgtgaaatctcgcatgcaagcaaactcctataaatagatgtgccggtcttccgtcaacgaccgcacatacttgacacaggcacccggacaaggacggcaccgacgatcgtcctcattaggcaggtgtagacggtgatagaggcgttagtaagccagtacaagcttgaactacaacacaagagggttacagctcctcagatgcgactgtgaagagctgcaaccccttctatggttgccgtcccgtcccctactgctatcatgactcagtcaaagttcatgttttcttgagccaatgatgctatattgcaagattgcttttcttggccaactaaaactgcgtccaaagtcggtcaagccagtcagaagctgccagagtcagcaaaactagttgtccacagggttagagtagagagccaagctacaattgtaggtgcggcatcagggctaggttgagatgaaagagcctgagcctgagccagagccacagcaatgtaacagaaagggtttcccccagtctccaaccggtccggttctcaattgcactctcctatcgtcatcattacctgacttaaagtaccagtgttcggtgcaaccctacaaacgctacatgaacagaaagcgacagtacaccctcaagtggaaccacccagggtacagtacatccccttttcttttcggcaggctaaaaataaaaatgtctcactagtgacgtaagaaagggaccccaaaagccctaaatccaagttccggctccaaaagaaaagttagcgcgacagtagtgagacctagtccaaagttagacgccaacaaggccggtctaaaatttttcctggtgcgaaggagttgcggttacgagtcgggtgagagcagattatcgactgatatcgccccagagtttgccgccctccatgtttccttacatgtaggtcacctctgcacatgccgttatgtagctgtcgacgatctgatcgacacagcgtccgattgtcttgtctgatgttgtgaacatcggaattgctgatacaccgtgcccattccgggatcatgtgattcggtgacgggaggcgaagactgaagagagcggcactgctgagagtagttcaaagtgcaattgccatctgacgatgttatgaatgctgggaaatttctgagcgctgtcccatctactgttctacgctcaaagctacaaaatcactacttctactcgtacaattacaacactcggaaaggtcaaatattaaacggcactgcaggccaggtatgaattattttgttaaattattagaaagtcaagagctcaagggcgcgcttacagaaggtaggcagcggcagcaatggcagcgacggcaccgacggtgaccctgttggcagaagaagcctgctcagggccggaggagatagcgggctgctgggtctggacgggagtagaagcggcgggctgctcgggcttggaagcggtgggcttgggagcgggcttagactcctcgggcttgggagaaggagcaggcttggactcctcgggcttgggagaaggagcaggcttggactcctcgggcttgggggaaggagcaggcttggactcggtgggcttggggccctcagtgatgggctcggtggggaactcggagacggggcaggtggtgatggtctcggtaacaacggtagtggttcgagtgcaggggcagtcggtgatggtcagggtggtggcctcggtgacggtgtaggtcttgttgccctcaacaatctcggtggggtaggggcagtaggtggtgtaggcggtgacaacgttggtctcggtcttgatgatggagacagtgccggtggtgagctcggtaccgttgttctcagcagactcgatgggagcagcggaggtgacgggagcctcggtggtggcgagggtggagttggaaacctgagcgtaggcggcggcggcaagggcggcgacggtggcaacggagaacttcattgtattagcgagtggataaagtgaatttgttgatgaggaaaacagactgagacgagaggggggtcttatatactgagctgatgtatttttggaaaccggattttggggttctggattgggtttgtgactcgagcttaattttctttctggagtttaattttaatttaggctcaggattcggggcttcttttaagcttgcggtgcttgtttttgagaaaagtgggtgtttagcggatgagatagtgagcgtttcgcgctgcatgtgaccatcgtatgggctaataataatatgtatttggggcccaattttatgattatgtcatcagatttgtcgtaggaggcctgccttgtcattttccacgccgctcaccactctcccaacccccaccactctgtaaactcggtcgcatctctttgtctcatgcacactatttcgggaacacacgcggcccaattgggaaaacatgcaagctaatcaaacaaacatgatgccaatattggtgcatgcttgctgcgccgtgcatggtgcaagcatctcacgtaccggcctaacaaaagtgatagaacctggtagaaacgtgatttgggggggatttttcgacaggccaggtattgctatggaattgattggagggagggctctgggggttgttgttggcgtttttacgggcgtttttactggcgtttttactggtgtttttactggcgttttcgcagcttagcatgtacttgtaccaacatcggccagttttgtgttttagtatcatgccactgttatcagtgctgaccccaaatgatgggttcctacagacaacatgggaaatatcggttaggcgaaagggctcgttgtctgcggcgccaggcggttcgaatggggctattttcgctcgtcgttccattggtctcacgtggcgcaccaatatttttctcgccagtctgcgtcattttctcattttttgtcaataggggaaaagaaaagaaagaaaaaagacaaaaaggaaaagttttaatgtcaaaaaaacaaaagaccatggttcaggtttcaggcacagggtggacgcgagaaaggagtgaggttggcggattgggaatgtaggctaatgtggaatgataagggttggctggagacgtcgatgggacaaaaaggagctaatgagatggaccttttttggccccgcaattgtgggctgaatttcaagccacggggaaatcactcgttcgtccatggaaggctcgtaggtgatccagccccacctcccccggatcgcccgatcgtcgctgaacatgctagacccagaaagcaaaagacgggttgagaaaaagcccaaaaaaagcaacgacaagggccagaaagcgtgccaaaattggcaacggtgctgggtcccaatagacgcaattgaattggcacaagaagatattggctgtcatgcgcaacctcaaggttcaatcagatcaacaaacaatgccgcccagatggttgtcctgggtaaccgggtagggcatcatcttgagcgaaatagcgagctggagtcggagcggtgatatcagccgtgcgtcacgtgaacccggcgctagttggtaattctccatcacactattgtctacactagtgccgtgtagccgtactcttagtgcggtctttcgggactagcgttagcaaactattggccaatagggaatccaacaatttttttatattaacataatacatatcaagaccatcaccgatagtgttagtgtagtatgtactgtacacactgattgaacccgtttacagctacttagttcacagtctgtactacttggacctgacacattccatatacagtccaaccgatctagttcacgtcatgtgtcagtgtcaaacgagagtgttgttccgcgacgagcggttccacgggagctctgcgcgcccaacttcatctggtgatactcgcagtagctcaacgggatctctgggttgtctgcgggcttgtctgttggtcatgctaacctctcggatgctacgctacaagtacaagaaagggttgcggttgcaggggtgttgaggcccgagaacccagtccgataagcctttaggctggatctaatcagctttgaagggatgtaaaagaacgatatcgttctctctcggagacaatgtaagttccgtggccaatttggaatgagcaatttgatgtttggcgagatgctcatccaagacagagggcatggattttggcgcagttctattttgatttccgtgctcgcctcgccctccacgtgactgccaatatcgaattgtacaatacagaccatgtctcactcactattttgtacaatacgcagcaagtttcacttgaatcatctcacctattttaagcaatcccatgaccagccctcttcctattcagtcacatgtctctgcggttgcttttgtgacgtaattagaggagcaaaaagagagagggagagcccatctcactggcaatccatctatggggtctgggtctccgagtgagcccccaacctcccgaacatctgccgtcgattcagactttggttggtgtcattccgagccgaaactcatcgcgcttgaccatctttaactagagagtctaaagttacttggctagtatgcattcttagttggatgtgccttaacccaatactgtggagggctaatggtgaacatcacgtaatggaacaggtattggggctgttgcggtcccattcagcccatctagtcacgaggaaccgcgtcccctgcgccgatttcagcccccgtcttgtttttggccctacttgtagcctttttcggtctctaaatcgctgcttgcttttgctcaaaccatgatacacagcccagagtttctctgggaaaaacaaatcgtatttctcagaaattggaaatggcaggaaaaatacgacaaaaacagcagtcccgttgtaagtactgtaaccacggcagtttgcatccaacaaccgtcaataaccgtcggtccagtcattcaagacatgcaacttccgtcccctacattcgaacaacacccgtacagtacatactcgtataatcatcctaaggtggtatggaggctcagctcagctcagctcagggcgaagcagtacatttcactgacctccttatgatcggatgctctgccgaacacactacaatagatgaaacacggctgggtaggattctggacaagctccttgagactcttattatttcttaatctcacgcccctgtgccctgagagcccccttgcctcctgctaaactctcactgttgtttatgttcaagtggggttcgtgtttttttttttgtgtttccatggtgacggtggttggaaaaaatatcggtaaaaaataaaaaataaaaaataaaaatatgccaaaaattacaaaaattacaaaaattgcaaataatatcccacacattggaagacgtgcagggccacatgtctacgtacggatgttagaccgaccatcatgcggctaagcccttccaagtggtattccaaatgcgcccaagaccttctatgccatgtattttgcaccacactgagaacaagcacgaatacaatcgtactcgaattattacgcagctcagactgcctctgatagttcctcgtctttgcgaggaatgcacatggtgaacattgccaaagccgctcgcttttcggctctcgttttgtgcttttcttcatctcgttttgcgcttttgcaccagttttccgccgcctcccagcgacccacttgtcaacaagcccggtattgtttgtacatactgtatcatgcaatgcacatattttagaagcacgcctgccccgtgccttgcattagcggacaactgtttgttgttgtgtgcgaaaaccgcaaaaaaacgcgtatgccatgtccgcacgtgttttgtcaatctcccggaatgttgactaaaggttggtaattgggttcgtggggggacgagtggacgtaggacgagagatggaaataaatggatgctatagacttgtagagctcgtccacgcgaccacggcaatgtatttttggctgcatttcgtcgcactacacgctgacttgggaaggtttttatggcactaaagtgggaccaatatgttgaaaaggaatgtctggaggatggcctgaaagctgcgcatgaaaagcggagaaccggtgtaattttgcatagaatggtcgagagatgttggaatcgcactatatcttccaaaaaacaacaacaaaaaaaaacatcaccagaactctggacttaactccccagaaccggacttaatactcccagtacaaggcttataacgctcctgccagaaaaagaatgatcgtgaagacgtgatgattttgacggttgcattattaaatccggagtgatatatgaacaaacacgtggtattttgtatccgcgtgatctatgatgtttcatcagccacatctcttctgatggtgtcatggctacagctttggtgaccttggaagaatgttgcgctgacagaaggaatgcttagtgatctcggccactgagcagtttgaaacgtcgagctacatcgcattgagacttgtttattgtgcacccaggaacaactgctagagagagtagtgtctcaagtgaaatgtgtcgcctcttacagagatgtcaagaacgtagagaaggtcgaacttgactctatacaagactcaccactctagaacttttcctgaaaaagaccttcatcgggctcttatactgcctcacgaatgaatctccaaaagaaatgtaagagagaaaatcaagacaacggcaacaatgacccaagaagttcacaagctagacatagagaaagtcttgacaaagaaagtcattgataccaagctttacaggcatgactacttttcgagttacttccccacctggcttggcaggcacgagatgcaacggggctgtcgacaaagaccctctctccatatgctggtttcactgattcaagtacagtaccataattgtacaggctgctgcgctaaggcagtctgagttgatgtatggataatgtctcatcttctctctattgcgatattagcagatctacagcacagagcaaagatcttaaagatatatacaagcagctacaagtcccagaatggacagttgcttcgaaagttgtcttaatggttgaaatatctggctacagtggctcggtttccaaaggatgtcacatgttacctcaataagggaccccattagtatcaccactgattccatccatacccactacttgtagctcagttcatgcaaaagctccacttcaataaataatctgcttacttctactctagtctcggctttttcacaccgagtcgcaaaagttgagctcaacaaacgctctttcacacctgcttagccatgttggacctcttctttttccgtctatcctgacgatgctgcatgtcaatatgcgacttcccattcttgtagatgacctgaatcctagcatgacacagctgacgatcaggaccctgtagtttcataaaaggaaccagctctcgcaaccctctcagctcttctcctttcttggacggcgtgttcttcggtggaggcattctcgcggagctctgagtagctgcagggggtggcactttcagctcaagatccatccactcttcttttctccgtcgctcagcttcaaatgtgatctcggcgatgtcaacaaatttggtcgcaaacgaatccagcataaccacattcgtatgtgtgcagtaaatgagctctccaatggttctgtagagagctacaatggacatcttggcagatgctcctcttccagtagccacagtggctgtggaagaatagggtcctgtagacagctgcagcaaagtcgcaatctcatctataaccaccaaagacccatgacgattactcaaattattcttgatcccagcattgtgtcgggctgaaatctccttggctctttcttcaaccagtactctaggtatgttctgtctcaaagccaccagaagcatggccatagtaggcgtatgaaccacaaacagcgatccaagccgtggttttgttctctcatctcctgtcacttcttgtgccctctgcttctctctcatctgctccagccaccgctccttatcgactttgcgattagctgtacaccatacaactgcccggccttcctcaagggtgcttgtcacgagcgaatcgacgagagtgcgagccagagggtgcccaggaatcgaacaaagctcaatcacacgcgtgccgagactgagcttgagttgctcgtccaaaggcgtgttggttctcattggatcacgtgattatacagcgtcacgcgactttatcttgggtatcaacagaatctgatcacgggacacgtgattcaaatcgaccgttggtgataacgcgcgtctgggtgagttcaaagtggtttcgcatgttgtggttagggtaagggggatgtcagtaggtgatttttcgtgggatcgaatttacacggatttcgcaaagatggtcgtattgatggagttagggggctgcgttttggtatattttttctatttttggacttttattggatttatggagaatgaacaaatatatacacgaaaaatgcaaaaaaaaccccgaagaaaatgatgaacgggtcaaattcgatagtactcagaaatgtaagtcaattaaacgtggaataactcgttaaggatagtattgagtaacaattggccgtctttggccaaataaagcgccatttccatcctcaaatacgccttcctcatccccgaaacaccaaggcaacctggccgagcggtctaaggcgccaggttaaggccacaccttaacataatatcctggtctcttcggaggcgagagttcgaatctctcggttgtcagcagttcccgcaagggttccttttttgccagtttggaggtttctctttcttgcatgtcggttgggcacgtcggaaagtgggaatgttgcgaccagttggccaagtcaatttttgtggaggttcagaatcaaaaagggatatgctcaagacacagatccaatgtatcaataatatcattttagccactttcgccactaaatctgttagatatgtgtcaacatggtcaactagtaagtggtcgtttttttcattatggttcttgacattagttgaaatactggacagatatagttgacttcttacactaattgccggccagtgggaacacgacacaattcatttacaaagagtaagagaatatcacagagtacgtgaaagtgagcctgggacgcaataagtggcaatacgtcagtatcaaaagcacaaacaagcctcctgtggtttccagcgtgtctagcagcacgtatcaccaacctccagtgtatgccggtcgactaacacaagtatacccaattcaggcatttgtactgccaacagggaagtgatatatatgccgttcgacataaaagggagtgttcagcagttcattatacttactgtaccagcctatagtcatctttctctcgccgaaagtgacatttctagcgctgtaactgtcgctattagatgttgcatgcagctacaatagacgaggagatgctacatactgtgcaagtacatgtaccgtatgtacagttctcacaagcaagagttcgctaacaccgcgaaaaaccagactgatcttggaccttggttgcttatgaacgatactggccgcttatgaactactcgtgacctactgttccccgcctccgcttgtcgccgccactaagatacctgtacttgtatggttcctataaacccactaatacgatgattcgtccctccatacaacctgaacatatcatacagtaccccggacagtcccgctgtaccaatacaactccccatacgatgccatacgtgactcgggaaactccacgtgttgactggaaactccgtctggctttctcaacagttgctgtcatgggtcacaccatacaacctcaacctcaacctcaaccgacagacacgtgcttctagtgcttctattaatacaactaaagaaccaacaacaagacgatacaaagacaagaccaccatgtagcaaatggtgatatggagcagaactcaacagaatgatccgacatgaacgcagtaacacaagcagagacaatctgtatcacatatactcgtactcgtactcgtactcgtacactccatttcctggtaactaactcactcatctgagacattgtcctcgagactaatctcggggtttgtttttccagcaacctccacaagcgccatctacaaccaatctacaaccaagaaaccactctacgtgatcgcattcttcacatagcacagcacgagcactgctctcatcatatattgccattagaaaatccaaaaaaggccaaaaaaaaaactatcaatcaatcaatcaaaccaaacacaatactctccaaatgataccgacagatgccgaccggaatctcctccttttttctcgttttctcgttttctgtctttttttgcgcgttttccaaggttttgttgtgttttttttttcttcaagttttcacattatcaaattccattggtggcgccgccgagtatcataaccattaataaaatatcccataaatcgaaatcattcgctgaaagaagctgaaggtgtccaaagacttttgagggcgtgtgccgaaaatataccaaactgtggtacacacggggcagccggggtgcgggcgcagggtactaaccgagaggctagtgctttgcttgagcaagaccactccgccaaacattagagtgctattggcgcgtgtggcgtggggggactccaccgagtggaaatgtccatcgtgttagtcgagttgcacgtgcaagacgtgtgtttgtgttctcgtccacttagcaagcaacaacgtgcttggggaagggatcaaagacacagtgggcgcagtcacagacggggttgtagtaactggcgatggggccctccttgcactccggatagtggtgggtgctgtgatggggagggggcatgggcatcacctgaggagccacatggtggtggtccatctggtgatggggagggggtatcgagggggcctgcataggggcctgcacaggcggtcctactgatgcaaacgattgttgaaagtaggatgtgaaagcggaggggggatgctgctggtggtggtgctggggagcacacgcgctgtccatgttgctagcgggctggttgtaccaagagggcacggtgtagaagggccgggtaggcgaggtcatgatgacggagccaaccttgggtttggacagcgacacgggcgagactggcgacgacgcgtggggcgatgtgtttgtggtcgacacctccgagttggagacagacaccagcggcgacgaagccgccgagctcttcgggctgtttgcgacccagtagttccagcagtcgttccatcggtgccagcccttgaggtcctgctgatcgagatgcagcgaccacgagattttctgcagccagtcggcctccagggtggtgagttcgccgacagcgatgccggtggcctgggaccaggatcggttggtgaaagtgttgtcgtcgtggaacttgttggccagcagcagcgacacgaccgacatgcggtaaatgtagccgcttgacttttcgtggcccagctcgagatccttcatggcccatcgtttcgacaggtagacgagggagagcacgacggtggcgcggggcagccgcgtggccgagagcacctgtgaggcaaacgccttgaacgcgtcgtggcccacctccgggttgggcttcatgatgcctagggccatggtggtgagaaactcggccatgtccttgatttcgtagtccagggtggcagacacgcctccggtcacggcaggaggggcgggggcaggcatctggatgggtgggggcacaacctgaggcggataacccatgttgtggtacgtcgggtagccgcctcgggtcatgtcatagcccatatcgcgggtcatgtcgtagtcgtagtgcgccgagtagtgggacgacatgggcgcctggggcgcctggtggaagtagccctggtccataggcggggcttgagccatgtggtggtggctgtaggggtactggaaggccatggtggagacgggcggtggtgctgttagtagcaggtgtcgatggcaagctccatgtactggtttagtgtggctggtgaaacgaagacttagcgaaaagctccgtttcagaggttggtggcggcaaacgagacggctttcggtttggcaaacacacagaccgtgagtaatgtggtttggggagaaagtcaggccaggcactattttttgtaggcgctcgaaaaagtgtttttttaagcgctacaactctgacatgtgtgcacaccttacgctgctcgttagtttccttgtttggcacactgtcctactttgtcttttgggagtttggctttgtgtttcttggcatgtgctgaattttacgctggggctcctaagagagcggccccaaatgtacgctgtctcaccgagaaaatttctcattaaagtacatattggcctggccagccaatcacagcgcggcgggaagccatacacgaggctcgagacgggaaattgagagtccttcaggggcacgtttgggcgaaaataaatacatgaaaacgctccttgcaacgcggagagtccgccagaggcggtttcgtcggcgtaccttccccggatcccgagataacccgcaaaaacagcgtctcgatcggactttcaacctctgctgtattttgtttcccaaaaacctctgccccgacccttttaaagttgaccatgtggctaaacccgtaaccagtgaggtgtttggaaaacattcggggcctactatacataccaaaatagacaaaccgcaaggtcaaaaacaatacaagtgcaagccgcccaatatatgccgttctacacctcccgctacacttccagctacacctccagccgggaccttctccacactcctacagctcacggctcgttgcatgcatatgtattatgtaccctgcccaatgtgaagtaattaaattcgcgaagccaacggacatggagaataattcggaaaataatcaaataaaaatctgacaactatccttatgacccctactcatatgaactgataccaactcttcaatgcccctccattatcactcattagtgcggctggacgccctcacaccccagttctggagccgtttgtttttcgctcataaatccccgaaattgaaaatgcttgcttttttaaatacccaatttaaaacctcgtagagtcacgatgcaaaatgcacagcataaaggacactgttaaatcgtgctatacgaacagtctagggggaaggggaaaacaagtcacgtgacaaaaaaccctcttcccccccccaaccgagattcccgccaccccgtcgccccctgagtacacacacacacgtctgtcttgtgactcatccacatggtcaacatgatattatttataagacggaacctaaatagaatttggtcacgtgacacataaagaatgtgcgaacgtcaactttatacagtggcggtgatgtcatgatgaaagtggagtcctttcagagggggaaataaatgatatatcggaaatcaggcgccaccataatgattgtatcattctcacgaacaaaatgcaaccatccgaatttttctcagattactttagcaaaatgtaccccctactcaacacccaagtccctttttttatttttatttttttatttttttataccggctcctaccactcaaaagaccgcagaatgagcacagaatatcgctcacgaaacacgtcgtctacgcacaaacgttttctaatgtacatttggcacgttacgcgtggtccctcattcagcgacctagtcctgctattcgaaagtgttgattcacgtgactgtgaaatctgcagttgtttcacgtgataaccctgtttatagtcacgtgaccaaaccctctttctctcgccccctccctccccaacacgtgacacttacttaatcacaccgatccactccaatcagtcacacgataattctatcgtttatgcatgcggggtgtggcaccggagtggctgagtcaagttgcgttgaaaggtggatgtggacggtattattagtcagaaaaccgtggatattgcggtattacttacacgtgatactttgtgagaatacgtgacaccttttcgctactctgcaccacgcttcgcaccccagctacttgtaatcccttaccgaaatacttccgctcatgccgaaatttgagttcaaaaacggtttctcccgggtcatttttcagaatcacttttcagcatgttagaagatcgatttttagaggaggttgacaatgtagaatcatatacatctggaatactgattctacttttcaactttcaaatatacccactattgagctctctggagagataccggctctgggtatccagggctggtaaagtttaaaacactcggctgattctcaagttttaataacggccgcagaacaatgagtaataatgacaccggatttcaatcggggatatggtcacatctaaggactggctatttgtttcaattttcagctcagtttagcgccttctgcacgcatagccattaatttttcaaatttcccctaaaaataaatcctgaagcttataatttttcagtcgattttgaaaacacctgttactccatggacagtcaaccaaatgatttcagaagctgacagtaaacaaaatggaactagggctatagatcaaatataacaccaccaataagtaccctttatttcgcgtagtaagaagttttctctgggttgttcagctgaactttatgtgaaaaacctgcacaatatatagacgattggcaggtcacctcttctcctcgtcatcaaacatactacaaacgaaaacaggagtggttcgaagttcggtctgaagcgattttcacaaatctatttggacgcatttaatatacctcctttcagtagttgccctttgaagacgaaaacaacatcattttcgacatgactattcttggtgaagacgacaacaaggtgaaggagctggtgaagggtggaattgatgacattaagagcattgatgtgaagaagagcgtgcaaaagtgcgtttccggagcttcttcggggctgaaaaatgcatatgagaccgtcaagttcaagactacgactcgagagggtctgattggagattatgactacaagtttctgcttacgcccaaaattccgtttatgaagaagtccaagaagggtgacaagaaccggtcgacgttttttgctgtcgattcgtctctgcctcttttgctggccattttgcttggtttccagcattctttggccatgattgcaggcattgtgacccctcctcttttgatggcttcagctgcgaatttcgacgcgcaaatgacccagtatctggtttctgcggccatgattggctcgggtcttttgtcgctcattcacattattcgattcagaattccaggcacccacttgtatgtcggcaccggtttgatttctgtggttggagctagtttcagcaccatcactgtcttcactacgggtctgcccatcatgtacaagagcggagtgtgtcccgtaagcgagactggagccccgttgccctgtcccgagggctatggaatgatcattgccactgcttcactgtgtgctctgattgagcttctttgctcattcctgccgtccaagtttctcatgaaactgtttcctccggtcgtcaccggccccgtggtgcttgttattggtgtctctctgattcagtccggcttcaaggactgggctggaggcgctggaccttgtttcggacgtcccactagcggcgactttatgctgtgtccctctaacgacgctcccatggccgctccctggggttccgcacagtttatcggtctgggcttcctcgtctacgtcgccattctcacctgcgaaaagtacggagctcccatcatgaaatcatgtgccgtggtgattggtcttctggtgggctgtattgtggctgctgcctgtggctactttgacgctactcccatcaacgaggctcctgtggccacctttttgtggactaccacgttccctctgaagctgtatggtccagtggtacttcctttgctggccgtctacctgactatcatgatggagacgattggagacattactgctacctgcgacgtgtctcgagtagcagtttctggacccgaatacgagagccgaatcaagggcggcattcgaggagacggtatcatcggctctattgctggtctgctgactctcactccctgctctacctttgcccagaacaacggagtcatcagcttgacaaagtgtgccaaccgtcaggccggtggctgggcctgtttcttcattctcatgatgggcatcttctccaagtttgccgctgcatttgtgtcgattcccaagcccgtcattggcggtatgaccacttttctcttcacctcagtcgcagtgtctggcctggctatcatttccagaaaccccatcactcgacgagacagaatcgtgctcactgcttctctggtgctcggtctgggcgccacgctggtcaacaactggttctccttcgtcttcacctacgagggcgacaaccagtctcttcagggcttccttgacgctatccagcttgtcatgagctcgggtttctccgtcactggcttcgttggtgtcattgccaacttgattatcgatgatgacgaggaagaagacgaagacgacaaggagcacacgctcgagatctgctcgagttcgtcatccatcacacaagtcgatcttgaagctggccaaaaggttgagtaaccaacaccaaaaccaaaaggatccgcaaggaccaactcgaatctctgattcaaaaacttgtacaaccaaaacgggaccgcaaggaaccgccgaaaacacaacaacacaaaaagaaccactccgtggctcgggctacattcacttgtagtcttataaaaagagggatcccgacgactcttctgatgacacccttgccagaatcgagactccagatcccacctatttatagatgttaatgtattattattgtatccacacacatggtctagtcctcacctggcaaaatgggataaaaaatcggggctatccaagctacgtactacaagtagtagtatagttgattaataatcgataccaccactgcatccatctgtagcacactgaactttctgtttcgagagttgaactcctcacagaggcagacacttctggccctttgacacaaccgctgaactcaacagtcagcacttggcaatagcttttcttaccctatacagcaatgttggattgttggaacagacattttgcagctgtcagaactacgcctcttcaaccctgggtctagcccacggctatatctctcattcataaatccctagtatggtctaaaacaccgttgaaacgttgaagttgagccgttgagtctgaatgtctcagtctagcgtggaaaatgtgaaaagtataggccgagtttatggcaatgctggtatgagtgtgagtgcaactacatacggtacgagtacctgtggtagtagccaagcgaccaaagtgcacacaaatactggaaggagtgtagatcgttccatcttcgcaccacatattgtaccagtcccgcttgccgtccccccccgtctccccaatcccgtcccgtcccctccatttcaaagtccaataccctgacgcatcgtcttccaccaactcctcggtccggcctttaatttcatttgggaaccttgtcgtttctttttctctgctcgaaaagatctccaccccatgcacctttggcatcgacccactctcgaaatacggttgcaaacgcatggaaggagtgtatccatagactcagaagaagggacacgaccgcggggggcgagtcacgtgaccctcagaaagacgagcaaaatgtctcacgtggtccgcgttctcggggtctgggcctttcaccgcccttcaaactcgacatcggaaaaaaaattggcgttttttaggcggcactttctcatgcatagattagacccagattgcgagacgttagggttcggggtgctccgtgggggtgggcgttagaaggggtaataatggtctggtagaaacgaaaagacaatcaatcgaaagctgagagtcagcagattcgtttggtgccgttattgatcctagaaacgccatatttgatcgtcctaatagtcgtctgaagcaaactttcacgcatgcagggtggaaatttatagtccgaagagagctcggaggtttggtatttatccggtgtgtggagacaggagtggtgggggtgcttggaggtagggagatgctccaagtactgtactaaacaagtggcgtttctgatctgtagagaaggacttctggatgtgctttatcagcactgcgcaactcgtatgttgcaacgtccaaggcggctgtataatagtggtgctactgtagccttttttcgtgcactgctgggggtcgttgttcagtgtagctacagtagctacagtagctacagtagtagaagtatggtggaggtgggagacttactgcgtgagcgtattgctgcgctaatgtagctggcgtattgggggtaacagcgtgttggcaggctgctccggggctcggaaaaacggcgcgagactgtccgtacaccttcaggctcgtgtatatctgtttatagcacaatcacattgtcatgtctcagtgccacttgtgccgagagttgcggcttccccagagtccaaaccggcttagagttgtattgcgcaaggcgtatcttgtgaggcgtaagtacagtagagtgagcgatgagagctttttgagtggcgtgggagcaggattggagggtctttatatattgccccaagggcttttgtgtcgccaatgacgtgtccaccaacccgctcactgccacgccccggcccccatgttgtattctctgtagggtggcaacaaataaaaaaatacaaaaccgtgggtggtgtgtcaagttgagtgcgatattacataattgtggggaaggtagcgtgggcccgaaaatagcgtgtggggggatgggagatggtgacacaaacaccgcagcacaggtatatatgccggtcgggcgcccccgtgaaggccttctttctacacgccacatttgtctttttccatcttcacaagtacccctccattgccagagagctccgggctgcatggttagcgcagcaaaactaaatcccaccttgcgcaaataagctttccccctctcgctcgtcccacattaattttcaacaccactgtttatctccacaactggacacacgagtcgctgtcaagtggcaggaacagattgagtggatacgacacgagcgcaacagagcctgaagcgaacgctcgaacccttacaatcgacacatacagtcaatcgacacagtccccaacacacacaaacaacgacactcaagtctcaagcgacacagacagagtcatccgacgacacccagacgacatatactcatactcaagtaactacaacgacacagacagttgctcaaagacccaggacgatattgaaaacgacactgaccaacctgaacaagactgaccagacagtttcaaacagcccagtaacgacaccaacacaacgacagagacaatctcgaccaagatggaattcacagccaccaattcagaccgagaaatgcaccctcccccggtggcagtgccgtcgcatctgcagcagtccacgacccaccgcacggtgcccaaaaccaaccccaagacgggcaagtccgaaatgccccgaccctacaagtgccccatctgcgacaaggccttccaccggctggagcatcagacccgccacatccggacacacacgggcgagaagccccacgagtgcaccttcccaggttgcaccaagcggttcagccgtagcgacgagctcacccgacactcgcgcatacatttaaatcccaacactagacgggccaagaacatgaacagcgccgccgccgccgctcacaatgccgccgctcagcagaagggccctccttctaaccagcagcccaaggacgaccgaacagaccgccttgtggccatcagtaatctcgtcgaccaccacgacgcccaccctcctattcccggaggcagtggtatcaagagcgagtactcgtccgcatactcgactccatattcttcggtgccgtcgtcgccaaccatgggacaggcctcgttgtacagaccttatggtgctggtccaggcggtcctcctcctcctggtggacctggtggactgggtggacctgctcctcctggccctcccggccaccatggaggaccccccactcacataggtctaccacccctacaccatcctcctcctccaggaggccctcattcggccgcgcccagtgctcccaacagtacgcccgggtcgcccatgtttgtgcgagtgccacattcaacctacccaagatcgactttcgacatgaacatgctcgcgactgcggcctctcagcagctcgagcgcgagaacgcgcctccatcgggtctgtcttctggtgctccctcggctgcgccttccggcacctccagccccttcaaccattcaccctcgtcgtcgccactgcagtccacgcagtcgtcccccgctctggcgtcgtatttcagtcggcctcctgctccgtcttccaaccccggaacccccggtagctcgcacggtcctccctacggcttctcgtcgggcacgtcgctgtcgtcgcatggaaacacgcactccaatcacttccagcacccacaacacttgcatcccccgcatcatcaccatggtctgcagggacacatctttgcgggtctgcagcgcatgacgcccatgtctggaagagacgactcggagccatggcaccggtctaagaagtcgcgccccaactcaccgtcttctactgcaccgtcgtcgcccactttcagcaactcggagagccccacgccggaccacacgcccctggcgacccccgcacattcgcctcgaatccaccctcgagatctcgagggagtgcagctgccttccattcggtcgctgtcgattggccgccacgtgccccccacgctaccgcctatggagattgcgcctcggtcaagtggaggcacccataccggcacccatacgccgtacggcggcggatctgcgtcgcacacgccgtttggcacatcacccaactcgggagttcctcctccgcatccaaacgcggcccagggcgctgcttcttcgcttagcatgctagccatggctggcctgaaccacgctgctgggggagctgctcctggaggcagtggggcggcagctacgtcgtcgacgcgcgacgagcccagcaacgatacatctgggcctgcgtcaggcagcgggccttctgctccgtccaccgcgtcgtccagtactcgaatggccgtcagtgacttgattgatagatgacactggccggtcgataatttaacgtgctgagctcagcacacgcattgcccattggctgtatatagatgaatgtaatgataccgtaagagaatgagagcacggtattgtattacaggggattaagtacacattacttggagttctgtaccagaagacactactatacatggtatcacttacattagagtcggtgaccgtattcgtctcgtatagacataatattttcctaccccacattgttcctgggccttcggagcacatctacagtgagtgactgtttcagttgagcttgaggggttaagtaagtgggggaagggtttgcgattctgaaaaagagcatgactaatctctctgtggaggagcaatgaagtcacgtgatgcaatcataccggtgtatcggatctgcctgggtgtctgattactaatcatttactcacctgttttccccagctatctcatccatctcagagcctcggcccagccttcggcccttttgggtttcacgacaagaccgaatcggactacatatgggtccccccgattcggacaacaagggtgtttggttcgcggacggcaatgtgaaaaaaaggcacggcactgccaatcggaagccggtattcgggtctccggacacccggctttgcgacatgtgtcaccttgaagggttacattggtctgcgttagtgtatctggcggtggggacgatttggtctgcaacgggttagggtgaatatggggggagggggaggagaaggagaagagaaggggaagagaaggggaagagaagggccactttctataataacacgagtattgtacgtatacagtccgtacagtggttgcttggttaaagacttggagagttggttgagctaggagtcgatagaaacggaaatggttgtactgggtccaataatggtcagatggtgaaaacaagcagatatttggcatcagtagatggatgactacaaaatgatacctaaaacggacagtaaatgaaccggctctatgtaaaatactcaatataatgtaacaatgacgggctcattgcatgacattcaacggcttcaacctaagtctatttttggacaacagatggttggtatgagtgctggccaaagtggcacagttttgttcccagaaaaaagtggttgatacaagagttccagactcagattaataagccacatttgaaatttaggcccaaatgattcactattgcgtttgttagacagaggcgaatttctttcactatctttcaactaactctaaccattaattatacagtgttggttaacgtatcaagggtatttatgttattttaaagaaacaaaaaacacagcatttactgtatcgtaccatacccgtagggatggcagttgatcaacaagtagtcaatttaatatgtatgaatctgaagtatggctatagacagaactcctaagccccaccagagtagagctagaagggacggcgtctctcttaaagatttcagcaccgggaacatcgccagtgatttccaccacgtcggactcgttggtgaacttggccttgccaagagtgatggtgtctcgagcgttgtcgtaaatgacgacagctcgagagatgaaagcagggccggttagaagggtcacctggtcatcaggggcaagtgtaaggtatcccaggtagcaaccgccctggggtctctttcggatgtgatgtgtcaaatccacgtcgatcttggtgtttccccactggtatgtgatttccggtttggaatcgcaagcaacgctccaggatttgtcctccaaacttctcagaaatggccttgacggtgctgctggtgtagacagagcccattcctccagtgtccagcacaatatcgtggtctcaggtaagctgaatcttctcttccttgatggaaagctctcaaagaggcatggcgtaactgccgtggtggttcacgtgcacggtggtcagccctccctcgtacctggctttatcatatcctacttagtagacattgttgacgacccccagggtggacgtgtctgcggggttgatgggcttctcggcgttgagggagtacacggcccgagagatcttgccagagcctgaacatagttcactttggggttgtcaatggcagcctggtcgaagattccgagctcgaagccggttgttcccgtagacacccaaatgtggaagtcctcgaaggcctggccagtgtatgaaaaggtgtctagaccgcggtgaccttcagctccccagggatcgggtgcaggaggctgtatctccaagtagaagactgggatacgttttaaggggatcggcagcgtttctcacagacggtggtgttggagccggcgagccacacctggccagatccggtatcaaatatcacagtcgggttttggggatgggttccaacctgcacttcggcctcgtagaaggtgtggcccatttcctgggtgccatggacgattccccgaccggcaagatggtgggatgcctctggggacttggcgaggtttcgggcgctgagagacaagtggacaataccagcagcagcgacggtagcaagaaggaggttactgaagagcgttgtgtgcgatacacaactccaggggctctccaagcgggtataagtacattttgacggtgagatcttgagaagggaaaagcttcaaccaaaccgagcactggatattaatatcgtatgatcggcgtcgaggtcttttcaggtcaattcttgatcgtttggttggttccatgagtgcaaacataaaccagataaatctctagagcacgaagaacgtttttgagccagcttctgggccatcttctgagccatcttctgagccatcttctgagccatcttctgggtcgttttcagagctgtcctgttgcacaaagtagtcgtctccttgggtaatttctgacctaccagccaccaacgtgaagctgtttggagaaaaagtgaatgatgctgagccctgatgatgggcgatccttttagattccatgacatgtgtgtcgatgacacggtcgattggagcacgtatcggccagtgaccacgggatccgaccctggaagctgactctcgagtttgagagagaaggtatcagaccaattgtcagacatggcatcaatcaggacgccatgtcgtcaaacagcccccaagcccaacaagaacatcatcatcatcctgaaggttaggttgggggttgcacaagtcgatgtgcaacgttgatcaggggtgtctcaagctttttttcgaagcaacaaaatcagaggccagaccattccctcttcgtcgatcatgcccaatggggtatttattgtcaatatccagatgcagtatgttgtacttgttgtatgagtacttgtagagtagatggtgatggagggcattgggtttttttaattttttttaattttaatttaatataaaacttgactttttacttggcatttacttgactttgatactcgggctgagaaaatgattggaaggtgatatgaaagaaacgaacaatgtgaaatggcccgaagaagacaaacagacaattgcaccgctgaagcgattcttcctctcgacctacagtagtccaattatcaacttattccatctgctgtaacagagagcgcggtaaaaatcgtcatagtgaggttactcactaatcaaaatttcacctgatagtaccatccctatgctcagtccatctccaaaaacttacataatcagagatactgggaacggtggcaaaagggagtcataacttctaccaaatcgccacccaaatcctccgcccgatatctccacttgatcttactagtgccttagtcaccaacgtgtcatgtgcatgacagatgcatcttgtacatagacgcacatatttcatcatctcgatctctctatctgctccatcaccatgaaatactgctgtccctacccccagtgcaagagccggcttgtcgtggccaacaaacaccccatcgagctgctggtacgggcttctgccgcctcggaggacgccctcaaggtccagaaggcggccctcaatttcgttaacagtaaagatgtcgtcgccagtgacagtgaaaagacggacacaaaggccattgagagcgagaagagcgaattgaaaaccgacgccgctgaagcgacccatgtcgcaaccacaaatcccgactcggagttcttcctgccattttacgatcccttcgactttgacaatatctctgtgactaagcctgtgttcgaggctggtcaagaaccgtctctaatttctagcgacggaaagaccacggtttccatcgaacgactcttggcatgtgctgagtgcgaccggggaccctttggagtgattggcaaggtctccaacgttggcacccatgacggtctgacccatgataagaacgtctatctgctgagacccgagtctgtggttgttaccgagagctgaccacccgtcgtggtcgcctgatatttatcggatagatgagatatatattgtattacatgagtataaacagggctgcagtagatgtagaccatgcaacagtagccgtcgtgtaggaaccacccatgcacaagattgcacggtcgagttttacagtagaaggtgatgagaggctcgaacagtacagtaccgatgatcgatgatccaattggatatattagctggttgacacatcagtgccgtgtgagctggttgacatgcatttaatggaggatcatggcgggaaaagagataaacgccacactagcaaatcgtttcgtctctctgcaaagacatttatccaggcaagaagcgaacataactttccacacacgtatcccttcaagaccggcatctggtaaggcaatgctattcctatccagatgaactgggatgaaagtcacagcggcgtctgtccaaaaggtcctccaggagttgctgttgtcttcggattgcaccagtaattctctactgtagggtggctgtgtgagcgtcattacgcaagtaacaatcgtcgcagactcataacaagttcttcgagcacggtcgagtcacggtgcaggacacacattcagaagtgacggaatcgctatcagaagccatctctcaactcctccttgactcgatcaagatcacgtgagtcaaccgtctctccggtctcttctttctgtctgatggccagggcaatagcctcctcagtaaacagtcggaggtactctgctgacgatttgatcactccagccgcgacacgaacatcgtccgattgaaaggactcattggtgaatattcgcaacacggtgttatcgctgaaagtggtgtttgtgctcatatcgtgcgatgggggagggaggtttgacgacgacgtgttgttttcgcggtgcatgaaaaatcaatttatcaaagtttaaaaatttggagtgtgaaaattgtagagatagataaggcgtaagttgtaagtgttgtgattcttgagtttcaattttgttcattttgttcaattttgttcattttgttcaattttgttcattttgtacgattttgttcgattttgttcgattttgtacgattttgttcgattttcgctgtttcatgtaatttaatcggttttaatacaagtaaatctacacaaacttgacagtacatactgtacactcgtactactttcacttggttagaagtagagaaaaatagattacagcagacttgtgccaacaatagggtgtgttatggaattaaaagagagccatgatgaagggcagagcaagagcagcggtaccgacagacatggcagaggcaccgttggcctgggcaacgtgctctccagcaggcgaaagagcgggtccggcagcgggagcagagccaggggcagaggatccgccggcagcagctgcgggggaagagctggaagatgaaccggaagaggaggaagatccagcgtgggcagctaatctagaagagctggaagagtcggaaacagcagagcctggagaggaagctccagagaaggaagatcccgcgtgggaagctgatccagaagagctggagccggaagaggaagaaccggaggagctggatccagaagaggcagagtcagtggagtaagtagtcttacctccggaagaggagcccttggtatctcccttggactcggtatctcccttggactgggaatgcgcagcctcgtgggcctcgacctcctcatgggtagcaacagagccgtccttgtgcttgtagcagccgcactccttgacgtagacaatggtgacctcagtggacgaagaggaagaggaagaggaagagccatcggaaccagcagaaacagaagcagaagcagaagcagaagagatgctcagagtggtgacaaagggagaagtggaggtggcaggggcggaaccggaaatgacagaggcagagccggaaatggcagagccggcggaggaagtggggacctcctcaccgttggtctcagctaaccagttctcaagtcgagcgataatggccagaatttggtcaagggcagcctgaagagagtcggatcggggctcaacgccctcgatgatggcgacaatggcctgaaggttgcccactagagtgctgacgtcgtcggaaagttcggcaatggaatctcgggcaacaagcttgaccacccggcgaacttgtcggacgagcagagggttggtgaagttgctggagggagaggctgaagcagtggaggaagcggcagcggccgaagaagccgactgacctgcctccagagcagggagacgggcaagaatgtctgtcagggaggcattcacggtggcaatcagagcctgcagctctggaatgtcgggaagctcggccagaacgtcagccagaacggcctgaacctcgctgagcacattgtcgagcacagagaggttggcggaagtggcagtggaggtaggggtggcagtgggagcggcaagggtaccggaggcagcctgggaggtggatccaggagacagggtggagggggtgccggtagcaatatcactggacacggtctcaggactggggttctgagccacaacaagggcagagaaggcaacaatggtagcgagagacagcttcatggtatgaggtagtagcgagtgtgggtagaagaaatggtctggttcttcttgtgatgggagctcattctcgttatatacactcctctcaactttggacccaccatgaaacgtgctccctggtccattcaggttgacacaagccaagcattcggttcaccaatctagcccacaatcccaccaccgtgatgaagaatggtgtcagcaccatgtggctgagatcctaatgggggaaggacagactaaggcttgacgaaaggcttcaggacaaggactctggttcttcttgaccaaaggctccaggacaaggacatggttcttcttgttctgactggcggttagtttgcaccggtcggctcctcttcagaacgcagcaaaccattgtctataccctttatcactgctggctgagactcctatttgtacagcgtgtatcagagttgtgatactcctcaggtactgacgcgttcgaggagctctaatgggacgggtacagtacttcgaactgagactcattggcgagctgaccctgcagaagctggcgtggtagccgccccaacgtatctattggtccggatcggattagaccagaactaacacgctgcaaacacgttcaagacaaagcggatccacaaacggggatggtgttgagaaggtgggtatttgagcgctatttgagcgctatttgagcgttttgcgagtgttttgcgagtgttttgcgagtgacgtgcagcgctaaacggttcgactttttctgatcatcaccaccagttcctgatagccagatggataaaacgaagggtcaagggacggaaaaccggatagtgtgtgttaattggcaactgatagcgccaaccttgcctcccgcacgccattactgcattttggagtatccattctgcccagccgcgctagtccacaattatccactattgcggaacaatgtggacccaacatttgttatttgcctgattaggagcaagtatgggaaagaaggcaacgcgatagtggcaaaagcagctcgatggtgtcctcaggtcgacctagaggttatactgcaccaccagagtctctagagagctccagtagtcagtgcttcacagacgaggggctcgtccacaacacgacaaacagatataatatcttagagaatggtcgatagacacccgatacccacgtaaactcgagccaaggataataaaagcccattccgatatcccgtgggcctttgtcactttcaaatctgccgacacagagcattctgcggcagcatctagacgctccattgatctccaattgcctaaaagagaaggcgttgataaaaagatcaacttcggattgttatgatgcaatcaattatgatacagtctaccgctctttaaccaaccagatagtacatactgtcgttctgatgttgttgtagagcctggtaaaggacatggtatcatgatacagctacaacgagtcaaggagactgtccagaggtctcaatcgctccttcgtttcatggtgaaacacacactgggatatactctgtactgtttctccattatgaatcatattcatgtaaacagaacaccagaacgagctgctcattctgcccgtctctcctgtaaccaaaggagtttcaatgtggcactaactggaaagaaacacttgtcttttcagcgacatctccttgtcctcgtattatccagcttttagtgcccctttcgtcctctcgacttagcgctctcgaacaaagaaaaatagaaccatgtcaagtggttatatccccgagtcggacggacaatgtataacgggagcgatttattggctccgtttttaggaactaacccgcaagccgtttccgctctgtgccatcgatacgactctgaaggtaagagaacattgacgacataggagtagctgatatagcccacaccaagtcgataattgaccaaggagttgatctgagctccaggatggatcgatcccccatttccagagtcgatccttcaaaaaatccgtcttcgatccagatatcttccactattatcgacatggcagagggaaagttcggtattaaaatcacgtaaggggtggatttgttttatattccgtcttgatttgattggttgacacattctggtgtctatagactaggtacgatatatactgttgtcaaaatatctgcatccatcgcatcggttcatgtagataggagaatagctacctatgccagtagttgtcaaatcatgtatcattattcgtttagtaatcatctagtattaaccatcgtccagtcgtctagttagtccaaatcatctaacacggccgctcatcaactatcattacacgtccttcttcgcggccttctcttcagcctccttgatgccctcctcgccaagctcaacctgctcctgcgcgtcccacatgctcttgtacagaccatccttgagaagcagctcggcctgcgtaccctcctcctcaacgccgccctggttaagacaaatgatcttgtccgagtcggccacggttcgcagacggtgggcaatggccacgcaggtcttgtcgccaagaacctggtccatgttggcgagcaactgacgctcggtgttggtgtccagggcagaggtagcctcgtccaggaacaccacgggcgagtttttgagcaacactcgagccacagccagccgctgcttttctcctccagaaatcatcatgcctcgctctccgacattggtgttccagccgtcgggaagttgtctgactagagcatcgagcttggcagcacaggcggcgttctcgacctccttgtcgtcagcctcgagacgtccaaaacgaatgttgttcatgatggaatcgttgaaaagaggagtgtcctgggggaccactccaatagcagaccggagagaagccagagtcacctcacgcacgtcctggccgtcaatgagaatgcggccctcctgggtatcatagaaccggaacgcaagcttgagaatggtactctttccggatccagacggtccgacaatggcagttttgaggcctccagggatcacaaacgacgcattcttgagaatgggtctatcggggtgatacccataggtaacgttctcaaatctgatctctccgttggtcagctgaagaggcttggcgttgggagactcctggatctgtccagccaccttttgcagagagaacagagatcccatgtccagcagactctgtcgcaggtctctgtaaacggagccgaggaaattgagaggcacggagagctggaaaacaagctggttgaccagaacaaggtctccaacggtcagggatccatcagcaaccccgcagcaggtcatgtacatcatagcagtgagagcggacgagaaaatgaggttctggccggagttgaggaaggctagagaagtggcaatcttgatactagccttctcgtacttggtcaaagcactctggtacttatcgaccatgtatccctcatttccaaacgacttgaccgcctcaatgttgatgagcgagtccagacacacgttggaggcctcgttatcagcccgattggcatttcgtcggaattttgttcgccacgaggtggtggtaatggtgaaaatcgcataggaaaccatggtagctccggtaacaagagcatacttccagccaaagttgtaggacagaattccacagaccagagagatttccagtgcaatagggatgatatggaacaccatggacgaaagaacaaacgaaatacccttggttcctcggtcaatggctcgagtaatgcctccagtctgtctgctgagatggaaggccatgtcgagcttgagcaggtgtcggaacacattggtggccacctccttgatggccttctgggccaccgacgcgaaaatggcgtttcgcagctctccaaacagcactgctccaaaccgggccgctccgtacgagaagatcaaagcggtgatacccactccaagagcagtggcggagttccactcaatgttcatgtcgtcaatgatctccttgaaaaagaagggtacctggacgttgagaagcttggcgcccacaagcagagccacggccacaagtactcggaacttgactgacgtcttgcccttgggccagatgtacttgagcatgtccttcatgatgatccagtcgagccgtcgttgttccgagttggagaggttggattcgcccagagcattggcggctgctttcactgagttggccgaagacttttctgccttggtggccagtttctccggagacgtggtcggcttgtcacccttctccactgcattgttggcggcgtcgtttgcaggactcttgttgatgttgtcgacattcttgtggttggcgttggaaaccgccggagacgtggaaaactgtcgtaaaggcgtcaaacacgccaacacccgcttagatgtcaaagtagccacagatccatagcctgatctcggtaaagacaaccacattgatctggtcgaaagggctggagagagccccctcacgtgacccagcacgtgaccggcccgcgccacactcacccgcatgttcattgatgcacgttcaaaggtccaaaaaagagtcggcaagctgacgttgaaacaccaagacaactatcaaggttctatctcacaacaaacccgcggccaaagagacttttagttggctgattgcgtatgctaaggttcgtcaatacagggtaagttcaacgacccaggggattatcagattgcacgtgaccaaagtgtactatgacaagaacggatcagaaatctccaacgccttatataaaaaaccagacacaataaaaaaagacactttgagccgctggacgcacttttccaagcggcaaaagaccctttgcactacagacgcgcgtgccggagcagcacaattctcgcatccgtaatccgggatccgacagttagagttagtagttgaaccaaaaaaacaaactgaactacaatgccagaaatacttgaaaaaaagtcaaccgctagttagaagacttttaacacaaattcacagactcaccaagttatataggccccataataccacacaaagcaacccatgaagaactctttcttttttgccacgccaagataccagaaaccgaagcatctcatccatcccactgagtgaatattgccaacgaatcaacaggtctcacatcgtcaaacaaaaccagaccccggacattactcccgaagcttaaaagtcacccgtaaagtatcttttcatgccaatcgcgaatactcacgtgacgccaactcatcgcacacctccgcaacgctacaggccgcaccggccgcaaaaaaacgaatttccgtacattagtttatataaaagctggttcaagacgagattcaaacaagtcaaaacaaagttccttaacgtagcgtggccaccacacctcctttctcaaggtgtcgggcagcggcccaaaatacaggccgcaggcagtcggcagttgggcgtcaaacacccagctgccgctccacctcccgcaacagctcgtcattgctcataaagtttccgtgctcgtcggcctcgtccagcaccagaaacacattgtcatcgtccaggctcaccgtagtggtcgcattctgggtaccagacccactgtggataaccagctccacaccgttgttgggatcggacatggggccgggtaagggcccgccaggaggcagcagagggtaccctggagcaggagtaggcatagggagcggacgaggcgcagggttggggccggggttaccggggatgtaggtgggtccacgagtggcagtggagttgcccagcccccaggagcacagcatggtgataaagcccgtcacaatagccacgtcggcgtcaatgccgctctcatccaccaccagttcatagtcaaatcgaaactgtcgcatcagacgagccttggcgacccgttgtcggatttcctcgtcgcctccgccagggttgacgattcgctccaggaagcccgaggaccgcgaccactcgtaggcagcaccgtcagcaaggtagaacttgcggtagatgccggtgaggccggtctcggccagcaagtctcggtgctggacctcgggcttattgtggaagtcgaagcaccggttgaagaggccggcattgacggtggccacctcgcgtcggtctgtggacagcacggaccacacggtggagaactgggtcttccgctcaatggtgtagacgagctggccgttgccggcaaacacgttgaccattcggttgcggtcgcgtcggttgcgtcggatgtagtaagccttgaggttctgggtgggcagcggagccacggtggcggtgccgtatctgttgaattcgagaagggctcgaatgccaaaggtgtcggcgaccaccgagccggccgtaaaggccacgttgagggtatcgacaatggctcctgacattgtgtgtttgtgtagttatcgagcgtgcggggagggtatcacttggggtatgaggtgtatggtgtctcgtagtatcgaagaggtgtctttgtgtgagtgagctgtctgtggatctcggttagcagtgtagcgcgagtgttgtagcaacaggaatcctttcttggtatctagagtgcgtgttagctgtgtggttgagaggaagagaaagttgggtgacaataatgccttatatataatagtgtgtgtgtttgtgaccttacacttacacatccaatgtggtgaagataagctatcgatgtgttgttgcggttacgacatgtgggctaattagaagaggttaaaagaggtttaatttgggacaagagaatatgggattaatggggagactttcttggggtctttttcgacttaaaatgatgatattttgtcacaacttttgctgaggacaacttagagaaataaaaaatatatcattagattctggagatcaacaggaatcgattggtggttgtttcatcgttatatttccaccttatcgtgaaccgcgttgtttctaacacctcccctacatgctgtacagtatgtaccctagaagttctctatatcaattcgtggccttcatattaccacaatttccacaactacgacgtacatataccaacaacaaaccaattgtgatcatgatctcaccatccttggtttgtgattactaatcaacgtcatattccaccgcacgtgaccagataacgtcatacttccgccgttactaccccatcattaatcacatgcataaactcaatctaatcacatgcactcctcgggccgtgtatatttttgtgagctttgattcgataggaaatcaagttacatcattagattcctctcattgagctctccaagtgggtactgcttttatctctgcagcttcacttcatcatcttccatatacgacccctctcttcactgtctcattacaagtttgcgcaaccttttcttctctccgtcctcttcatcaccgccaccatgaccgcgactaccatcatcgaaacgccggattatttctattcctctgtgctccccgtggtccaaaactcgttcgctctagaccacaagtgggccgatggagtgctatatagagacgagtctccccaggacgtgatttacggcgacctggaccagaagacgggctttgtgctgtttatccaccagaagtggaacgagcgggactttcgagagctcaatttgatcgccattgcctacagacacgacgttcacagcctccgcgacttggttccagaccatgtggactggctacagagcatgcgaaaccaggtggtcaatatcctgcctgagatctacggaatcaaaatgaagagcatgcagccggttctctacgtgccctacccccctggcaagtaccatttccattttctgatccgagaaaagtcttccccgatcttgcaggaagagctccgaagtggccgggctctactgctggaccatgtcattaaccagcttcagcagggggttttttaccgagacgtgactctgaagtttgaggtgaaccagtagagagacgacggaaagaatgaccaacggccatgaatccacacactcttgaagcacgccgatactacacataactaacttatgaatgatgaattatgagcgataccagaaagaccgataggactagagtgagtaggtgaagtcatgagtaaacgaagtcagtaacataattgaagagatattgtccttgctctttgttaccacagtggaatctctcataaaagccctccttggactttcagatggtatttggattgttgaaacggcattgtaaatctatccaattcagtagttgagtatgtacatgtcctttgtaactgataggcatggtacaaaattacgatagaatgaataggctacattctacatcaccaagtacacttgcgaagacgtttcccagctctatcaccgccatatacaacccctcagaagaagtacaaccggaatacggagagtcagatgatgacgaaggatctcattagacatcttgcagacttgtaaactcaacttcttttctatcaatttcttccatattttcccaattaatctctgccaaaaatcaccgaaaaaaacccatttaatgatgactaatcgaatattaaggtttttctacaatgcagccccttgcatgacaatggcgttatttattgggataaataagctcgcgaccgttttttgcagaattccatttaattcgttaaaaaaccgtctgagagaaaatctgagaaaaccggcgtgttctcgaaacattgttgatttcaaaaatacaggttcttccgctcattcctcccatatatgtctaccacgtgccacttgcattatcaagcttttatcatgcacattaagcttctagaagggaggaaaagggggctggacgatggctggctgagacatgcctccgaaagtggctgtttcaaaatacgcagcgctgtaacatttgccggagactgtaaaaacggccatgtcacaaacacaacccagcccgaggccgtcgcggcttgtctcacgtgtctcgggctggtctggggtgcactgatatcaacggctgtgcatggtggggagtggagcgggcaatgggtggggaatgggtgggcgtcatgcgatccaggagatattgagaagatgatatagttgattctaaacacgccaattactcttctggagaccgttactaccgaggagatcacggtattctctggcttctctcttatcagagatatcgtacaacatgtgtaggcttatctgactgctatccacatctttataagacgtaatacgtggttccatctctctatttgtagttatatgttttgatcacgtccctgttatctcttgagatgtaattcaatcccgggatacctggtccgatacctggtccgatatctggtccgatacgggtccaataaccggtcccccatcagactatcactatccaatcatcaacgctcctagataaatatcaaactgcaactgttacattgccagttgattcagttgatgaattatttagtcctattattagacccgctctcacactctgacaatactgcagcttgtagcgctacatttacattagtgagtcttatctcgacattgtgaagtcagaggatgtggtcagaataggcagaaataagaccaacttatctatccatagaccccactcagactacaggttcagcgctcctctcatcagcatcgatcgataagttttgattatttggaggtttatctctgcaatggaacgggttcagcgctcctctcatcagcatcgatcgataagttttgattatttggaggtttatctctgcaatggaacggctgtacggcgctagaattgagactcagacgcatacgaagccaccgtctattaccgaagacctgcagtgtcatatcttatcatttggtctcatcgagtgtcttatcgtagcgtcttatctatcggttatcgaggatgctcaagagagaattatgagagattttgtatgacagaaagagggaatagtaaaactattataatattcagatcgacacaagcattttgatatactcttgaggtttatcgggaacttttgccttacaaattttgtcaagtacagtatgttcagtcatatataccgtacttcatgtcagaccaggcgtaatattgacgttggggctttgtaaattcaaccaattgatgatatcagcccgataaccccacataccatgtcaccttctcatcatctcttccacacacagaattctattgaatctaggtcaacccactatctattcgaatggtcatgtgacaacgataaaacacactctatcagcccagcctgatccggcggagctactgcacatcaactgtagactgtcttcaccaccccagccatcgtgactctgctgttagcacaagctctcgcgtgacttctaaaaggtttagaccgctttgagtcatacgtcggtgtttctggtggaatattctgctcggtgagcgactagaaacccggaaaagaccacttattagtcataccaatctgtgaggaccgcaatctccgctcctttacctctccacccttggccctatcttcgttatctctggctcgaccagatcgacataaaagtcaaaaatacgacctgatagtgaacaaagggcctatttggggaatgaacatacagacattggagggagagaggaagcatggtcatcctggtcgtgtcaccgcagaaaaagtcgaaatggtcatctggtgggcagtgcaatcctgtatggtagcttcaggatgattctacaactagtaatggagtcttgaaattgcataaacgtcttgaactcgaatcaaacacgtctggacttggctatatccagatttaggtgttggtgtagttggttggcatgagtgatagcaacagtactaccacaactatcaatatagctctaccagctctacaacacagctccacaatacagtctacaaacacgtcgttcaatgttaaattaatgttagaataaatacgcaaatgtctagagagacatgaaggagtcttgagaaaccatggagtcccgtcgagaagccagaacgggagacgaggcagcagcagcagaagagttcttggaccaccacagctggttggaaatgcaagtgttgccggtgcaaccgcagggaagagcgtggttgtcaccaacgttgtcctgctgaatcagcgaaggatgatgggcaggaatggacgtagaagtggtcttcttggtggaaggaatgtagatggagtccatcaggttggttatgctttgagagtccattgtgagtggtgtgtggtgtgtgaggtgtggaagctgtgaagcggtgtttgtgcgacgaaagagtgcctgaagagtgtcagaagacgatgatatttcttttcaacaccggataccctccctttatatcttgtcaagcccattgctatatagtcatcgatatatgccagccttatgaaccttatgaaccttgagcttatttatttttacaaccgcaaacttaaaccttgcagagatacatttgtgtacatggactggtctgtggcttgggccgttacacgagttgctcccttcccgatttgggttgggttagggtattctgttttggggtaaatgtaaaagccctgcatgtaacaacatgtaaccgtgccctaacctggctcgatgcattgggaggttggattcggcactccttcctttttggggcgccctagcccttgttgggaatgccaaattggggtggaggggggggattccattaggaggttgtaaatggattgtaaacagtgataaacggagcttcggaattctgtgaccttttctgaacattttgatacttttcaaattcttctagcctcaatattcatcgatttactgctcatgttgatttttgttgcattttcaaattaccccagattttatgaaacctaaaaacaatgagaaataacccaggaattgtagaatatccaaaaaaagttgggaaaaatcggaaaaaaaatcggaaaaaacctacaccagaatgtgtccattagaaatggaattatcaaataaaacaaccacttcaatcattatattcaccagaaaaaccacattcttccgcaaacaaaacctaatattaaaacatgtaaaaatcatgaggctgtggcggtcgcgagggcaagcaacaaaaaggggtatacggaggatcacaagggttagggaaaattgttggggttagggttatttaaaaatagcgcgtggttccaattgggcttgtgggtttcgtgtcctacaagtagtagtgatctttggccaaatgaaaaaaatgaagaccaaaaagatggtgttatttccgtcgatgttggagttgtgacagatttgaaagtatcattctcttcctctcgacgaggaaattctgtctgtatcggtcatttgcgtcttcagtcattttccgaccagacaacagccattaaaacatttacggttcaggatcattgtggaattgagcaagtggaggatttctcatgaattccaaaaaggcaagatcgtgacacattttccatgtgggacgggatgcattaatggtgcacacagcctgggttataaatataaaaaaataataaaaaaatcggggggaaaaaagggaaaacggaaaatactctgaaaagatatggcaagtcaatcaaatgagaacctctttcaaaaaacaatcatatctgaacatatcaccacgctgttgaaagaccaaaaacaatacagagtttaatttctcatgcaccgaactgaaacagaaaaaaaaaatgaaaattgcacggcacgtgggattggaaggaggagaggaagtagggtcacgtgacgtgaaggagagcggagggttgcgtttgtgcagggagaaaatgttgcaaaatacggtttcgataccgtgctcttttgttgatgtaggcaatgattctgagagacggaagagaccacaggagacccactttgatctgcctccacctggtcgagaagctcgtttggggtggtggggggagttggtgggggaggggagaggttgttggtgtgttgaaggggtggttgatgggattgtttcgggttgattggcctgtgttgattagccagttttgatttcatttggtttcatttggttcttgttatttttctgacaaccactatcaatgacacctttgttccggcccaatcagacaggcttgctatccactcgtttcattgacctccaacacgctactgtttacatgtacttgtacactcctgtacatctctctgggctgtgccgagacaccaaatgatggaatatgtttgcggtgggatgaataaaatgaagagttaaacagacgcaccaaggttgcttttggcaggcgcagaatgggactgtccgatccagtatctccaccaatacgcccacttgccaaaagtggaggcggagtgggctaaatggctcaaagaagggttaaagggagtcaacgggggacagctggagaagtagggatggtgtacgagacttcagtggttgctccccatccaaattcaggtgttttgcgtcatcagatgacggttcagttacaagtagtacgatctcatgagttctttatttgacggcgtctaggaccggaatttattattgtaatggatgataaaaaatgtaccgttggattcggaattctctactgattgcaatgattctataaaatggcctagtaatacgagtattgtgtatatgtggtacagtatgaagttggacttgttcagatatccgaccctgactaaccctgattatagcaagcaagtgacaaacgagcttttaccagacctagagttgcgctggaagacacgttgaagtccaatgagcatcttttcgaaggtgatacggtttgatattgagagaatacttgttcaggtacagttcaatatagacatgccatttatcccgcaaattgggtcaaatcgaggttactcgtggcactgaaaccgagtcttgaattggtgagaggaatagggggttgattagagtgatttatttgtacttgatcaacccgcttgtatcaaaaaaaaatccaatcgttcttctttttaggagtgatttcattcatctaggtcgactttttatgtggatgacgatacaactgtgccatgttgaaaaagacaaagaaatcgaatctaacgagcatatagaagctcgctacttgtacaggcaaagtacaagtacttagatcagagcagctgatctcatccataagtggatccatctacatgtagtagggccgacagacatgtcagaggtcgactcatgaggctccctagcttcagtgtaaaactagatttttgatttgtcatctaattccttccaatgagtcgttgtcatcaaaatcactctaacattgtctcattctccatacggtcgtcatcaccagatggtccatgcagctggtgcgtcgataatgcactgataaacccaacccgcagaaaggggtctagtgatcttaccgagtcatgatactcaacaaaagcagccgtcataccaccgggaaggttggaacacagagtggcatgacaaaagtactcaaaaataactcagacgtgcgtgagagtgagagaagatggaaagcagctgaaggagtgacagctatttatgttttgttgtggctaaaacacatttcgacgtcgacccatcatgattgtagcactcgattacacaataaaaagaaatcccgaccctgtttctggtatgcagagggacgtagagtgcactgacggtgataccgacgggaaactgtgcctgagagcgccgagaagggcaacgaaaaaagctcttgtgcgaggagactatcgcggaggtcaatgtgcggtacgagtgggggccgagactcacgagaagaaataaacctgctccctcaagagcaacagagacaccaagatatcacgtttgaacccccgtggtagatagccttgtcgattttgtctccatcacatctgcaaccagctcttcaatatcttccccatttcgccctcctgcacctttctggatccatccctggagtaattgtcctgtatataccatgcaatagttgtccagatcctgggaaagatttacgtgacgattctgtaaaaggtccttatgacaaacactcggcgacttcgacttagacacctttaccgagtatccgacattattgagggagaacctgaagtgccagtagatttttggaccagcagatgatggttcagaactgaagacactggctactagctacccattcatttcattcgtgcgaaccgcgtcttagtcaaaaaaacacagggctcctgttgtaccatcgagcgccggcttgacacatgttcgagagctactttgttctgaccgctccgccagagtgagatcttttcgcagcgtccaaaaggaagtcctggagctcttctgagacaatggagagccctaggagctgtaccaatcacattttatgacagtatactccgatcgaaagttgatttttgagcctctaacatgccagtgacaatcctccccgtactactcctttgacaatagaacgactatcccgatttttgcgacttttgtcattcctcccgctcggatgatgaagcatgagccgaagtaaaagtacccaatctgatcaaactggtactttttctggtgttgtgagatagtgatattgtagtcatagtgatattgaggatatatattcacggtacaggttagacaaactgaagggaacagactggcaaattcgggtcgacgtatcctctataccatgttacagtctattgccagtggcgacctacagccctgacctgacgtacagccggacgtacagccggacgtaccgcgactcgctccatctctttattcattcgttaattacattttgcggaatcattatgattcaggtaccaatggataccgttagcttttgggcctcgttttctaccatgagaaggactcctcaaagtagtccactcgctcggacttggactcaatgttggcgcaaagagcctgtcggacgtcatcgttcatggcgggagggccacagactacaatggcggtagagccggggctctccttgaggtactcgggcagcagctcggccatgtggggccggaagtgctggatgttgaggttatctctgttggaggaggtgatggagagtttttcgggagacttggactcgagttcgcaggcctcctcggcgagctcttcagccagaccttccttcttgtcgatcttggtgatgtagaggttcacccggactcgggggtcggccagcaggtactcgagctcgtctccaaaccactcgagacacgagtcgcctcgcacgacccaggtgaagatgatgctcttagaaacggagttggcaaccaccttctgcgcgtacgagtaggtggcggtgattccgataccgccggcaatgtagatggaagagtcgtacttgccaacggggtgcttggcgccatagggaccctcgatcagcattttcatgggccgggctccaccggcagaaacgagccgggtgacaatatcaaaggtgattccatccttggccttgagaagaagggtcatattgccgttcttgcacgcctcaggcgactggtaaatggtgaagggatgagactcccagaacttgttgcccgacaggaagtagatgtagacgtgggctccggggtagattgaccagagtctcgaacaggggatttcagccttgacaatgagctgttctcggtcgacgagagtaaagtcgccagtgacaatgcctccgcagtaggcaattcgacacactcggatgattcggtcaaagccccacacggcaatggtggcccagacccactgcatccagccaatggtccagcagtggtaccaaagaccgacgacaaagagaataccgaagacaatgtgcaacaccaggaagatctcgtaccatcgggatcggaacacgtgcatggcctgcaacaacatgagagagccggcaatggtggccactgttcccagcacccagtagagctcggcagcgtctcgtgccagcgaatgacgacacatccaggtccagatacacgagtggatgatggcgtagatcatcatgactcgagaagtccatcgatggtagacgttgaaggtgtcgaaggaccagccggtgagccacatgagcaggttgtttcttccagcaaacagaaatacgataggggcctgggtaaaggacatgattcctgttctgtcggcaacaaacgcctccagctgagctccccacggaccggcctcctcgtagtcgtcatcgaaagggtaggaggggaaacagagcacgaaggccatgatcaagtaccccagaacaaccagcgactggattcgagtgggtgaagccatcttgagaggatcccagcccattggctgagagtgcttgtaaccaaacagagccggcagagacacgtactttcggaacttgttgaagccgaccttcttgtacacactgaatagagcgtgctgagagaagttgatgattgttccaataacgaacaccagggcccagtaggccagcagagctactccgtagtacgacgcgtaatctagggcaacgtagtgaggtttgacctcctcgtactcctcctcccaatgttctcggtcaaacgggacgggaagatagaggatttcggtgggatcttcgggttcaacggcaattttagtggcgttagcaagccactcatcggtcatctccagagtcaggtagttgggacagccctggatgatctgttttcgcacctgggtatggtagtgttcaggctcaatggccccctgataacagagcagtttactctggatgaagggcatgaccttgcagtactcctcgagaatctgctttctggacttgacagtgctactgtcaaacttggggaagttgaacttgtagtgacctccaatcagatggtcacagcccagcgcagcccagtagggcttgttgttgagcgagtcctggcgtcggtaggtctttgctgacgcagacgaggcacttagaaaagtgaccagcaccgtggagactttcatggtaggcgattgagcagatgaggttcgccgtagatcatcttatccatcgtctttatatctgtttgcatggactgatgccaagaagggaaaaccgggcgaaaccgcttgaaatttcacctctgccaagaaaagggcctccgatatgacttccgtcaagcgcaatgtggacaaagaccctggccggtgccaatcatggaatcgctccgagatgcagatgtatgcaagcttctaatcagatccagtcggacatttcacatagaaaacgaacaaagaagatgaaaggaaaacagaggatatgaatagaatcctctgatcgagatctttccatcggtaccaataactaagtcgaaaagtggccagctcgaaagatgatccgacttggtcttgaactcaaaacttaccaacatttgaaaaaaattatataaaaaaatactgattgacagattaacacctccttagattggcgattagtgcaatgatggaagagcttggcacactaatggcttgattacacgatacagtgactttccttacccagcaacttttcaaccgttgtctttgttcagatcagacacggtccactactgcgcaccgagcaggtaattaacaacagtatatatccaccaaccggcacgccaagaagctcagatgtcgcaccaaacccgcccagtctggttacaacttccctggtaggtgctggtttgagttgattggacgggggtcatctgtgcatgtgccgaggcaggtagtgtaggtagtgtagtgtcttgtagatctctattccatctgataagctgaagaagttgtatgagctggatttcaagtacagtagagatggagtcagatggaataaccagcacaatgagttcgattcaatgctctcactttgctgcaacaagttttccatcttttccatctacaaaagatttgattgataacttttcatccaaactttaggacgactgaaacaagcccgcgcaaacaatgcttgaagcagaagtaataaccgagtcgagagatggtatgcgatccggcaggagaacaagaaaaaccaccgttaggaacatgcttcttctgctcaagccgtaccttccagagcaaaatacgacatgtgctcacgtgtcttgtccgaacgagcttttgtgaagaagagcccaagcttttcacgaacccttcaagctcgtacttccaggaacccccttgtcttggcctcgtcctcgtcttggcaaaaggagcgcctcctccatgcggaacgtttggtcgagacggattgagttcaaacaggcgagaaagtgaaattctgcaacttttaaccacttcagacagaaaggaagcgcgtcgaacagcggattcggcgatcaaagcaaccccagtacttgaacacatccaaaagccgccctttattggccaaaaccgccctttattgcaaaaaagccgcccttcattggctgcagcccggtccatctccggggtttcgaacaaacgtcaattcccgggtaaacggcactgtaggtgaagcggtagatttatggaaaaagaaacgactgaggaatcagacgacccggaagctgctgttcttggcggtaacggagacaatttatatctacgagcattatcgtgcaattggtacggttagtggaagatcaaactggtaaaacagctcatttatacatcgatgggcagattacaaggccggaaatacatcgatatccatcatagtcacctcctcaaatcctttattttggatactagttcgcaccaagcgcctctcaagatctttatggagccaaaaaaaagattacagcacccaggattctcgtatggtctcccactacaatactaactgggctctctggtgcttgactatggctgatcggacgggaagccgtattttcaccaggatatggccgtaacctaacctccgcaacggagaattgaactccggtcccccgcgtgctgaactttaaatgttctgacaggcggaaattctagccactaaactattgcggattgtgtggtggaaaaatatcgttgaaacactagattcggccattcaaatcacgtgacctaaaaattcagaatagaaaagaatatcccatttatggatgctatgaaggcattgtgcctacataattggtaacaggagagagagaacgaagaggacaatgtgatgaaactaactatcatccttctgggtcttttcatcttgtgttatgagaacgacagaaagacggttctgtaaaatcctgtgttatggagctggacattgatatacgcctatggggttcataaggagctcatcgggtagtgtgacagtttttaagacaggatcagcttcagcaagtcatctcttgaacttatcgtatcccaatacacactactataacccacgataccgtgatactgctgcatatattcaatacatttactttgttttcttctccccgttaccaatcacaatggcgttcttgtcgatccatcgagctcgcagccaagcggtcagctgagaccaggggtaggtggtggcgtttctgccgttatcagccaggtaccatgactggcagcctccctgttgcaacagaccctgggcatgggaagaatccacatcatgaatccaccggtcgtaggcctcggctcgcactccaatgtagtctgtttcacccgaaatgagcttcttgacacccacggactcgcagaacttgatggcgttctcgatggcaaacagcaccgagttatgtccggtggcagagttgggtccaaagatgaggaaattgtttgggaagttgggaaccaggacggtctcataggcagaaactcgtccgttggcccagaagtcttccaggctgactccatgttcgccgatgaagggaatgttagtaaagcctccactaagatcaaagcccgtggcatcaatgatgatgtcggctgggtaagagttgccgtccttggtgatcaccttgttggactcaaccttgacgacccggtcgaatgtcagctccatgtttgggttattgagtgcaggccccaggtatccgcagtcgaagatgagtcgtttgcacgcaaactcgtagtcgggcttaaggaccttccagtacttttcgggagatttctttcggatattttgagtcgcgtgatgggctcgaattcgtcggataaaggtgcccaaccagcccttcttaaacatgggataggcggcctcaatgacaaagaagacaatggtgcgcaaaagatggagcacaaacgggaaccgggtgaaaatgaaacgggtgattcgtccgggcacaaactcgggacgaggagtgatccactgtggagttcgagcaaactgggtgagagtctttgtctggtcatgaatagccgcaattacctggatggcagaacatccgttgccgataacaacgacattcttgttggtgtagtcgacagaatggtcccatcgggctgtgtgcatcacaggacccttaaagtcggtgtacagaccctcaatctgcacgcggttgggctccacaagtccgcccttgcatgtgaacaggacgcgacacttgtgcacccacttcttgccggtttcgagagatcgcacgttcacataccacaacttctcgtcagcattccacttgcagccctcgatttccgtacggaaagtcgccatgtgccgcaactcgtacttggccaccagcttctggatgtagtcgtagatctcgtctctgggagggaaggccttgctccaatcgcccttggggtcgcttgtgagacagtaccagatggcaggaatgtccgatccacagccagggtacgtgttggccgcccaggttcctccccaggagtgatctcgatcatagagatggaagtcggcctctttccaggaggttctgagcttgatggaggtggcgaggccggaaaacccggtgccgagaatcaacacgttggaaaacaacgatccgtctgcaaatactgtcgacatgttgctgattatgaaagggatacagcagggtttatatgggtgatggatggcgtacttgagcttaaccagcgaggggaaagagttacccggagatggagggcccgagggggggtcatatatgtatcggtcgacgcagaataagcacgcgaatcgattgccgttgtcagatttgctctaccatttgaattcagcacaagataaccaatctccgacatatgcacttaataagcacgtgaaaagtaccccccagacgacgctaaaaatcaacggcctggaacaacacgagttgggacaatgcccatttgccgcctaaacgttaatatattaccccagacgcgccaaacatgggtattcctcaacctcatcgggtttaataggcttttggacaagtctcaagtcggatatacggaaggaatctccacagcggttggtagtgggccattcagaatttttaaagagaaaatcaatccacgacatcaagaccaactaaactcgcttttcagaatcccgctatctttcctggaacacgctctaaaacccagcccttgttcgcacacccactttcacgttgctgcttaaacttcgaccaaacatgttgggtcatttggtgagctggttatcagacaaggtgtgaaagaagaaaaaaacggcctaactggggaaaaaaaattctcccacggtcaaaaagccacccccgctatttcgaaccccggggcgccgttatatcccggtcacgtgacccgaaataaacccaaataacccccgtcgatgcgctcgagtcgtccaagcctaaagtttttcaacccaccgttgagccccgcttcgcaacttcgtcatccccactcaccccaaaactttacctcggctcaacatgaaaatgtacaatgtggtgtgacggacagacaaacaaatagaaaactaaacccccaacgaccaaccttgtgccaccaggccaatcacgtgacgatagggcttgtgggctggtcggttactggctgtcgtactctgtcaggaacgatcccaggcacgtgcagcaaacatgcatgatctgctcaacaaaaatttaatgaaaaatgtggggaatctgcgtggggcaaagaggtcatgtgaccgaaccacaaggtgacaaggtgggggggggctgtgcatgggggtttggagatagatgcgaccgttgaatcacgtgtacgacgataatgagaagagtcggactttcgaatggtcccgaaatttgggtcgtattaatagattgagatttaaaagcgtcaacaggcatcgaactcgctagcatcaagtgtcgagtgtggtagttggatgagtttgattctcaagtaaaatatcagtaaatcactgatcactgatagagccgttacttgatgtttccctctgatctggtaaaataaaataaataaataaataaataaataaataaataaataaataaatataaaaaatggtagaggaggaataagagataaaagaggaataagaagaacaagaggaggaagaggacaacggcgagcatgagtccgtgcgacctacaagtagcaagtttgtatcgtcaactccagtctgatacgaagatattttaccaagacagagatacggatcaaccctgttctgctctcaaagtcttcatggtggaaaaaaggctttatagaagatatctgaccgaggaatcgtctacggacaggagaagttctgggccagcacatgctggatgaacttgaagacacgagtcacactgagggatcttgccggtgattccattatcgaaactgcgaagaagaaacattggacgctcctctaagcacatctgaggaaaccggacagcacgaactgcgtagcagccatccacttggcagacgtcgcagccatcattcttttttttctataatttcttttttccaaatttttaatttaccaaattttcaatgtttcaaattctcaatttaccaaaaattcaatgtttcaatttttcttttttgagaaattgtcatactggaatttgatacatgccatagtaatagctcatcaccatcgctacccatgctgcataccggccttctccggcgtagcaaaggtcttgtacggaagatctaagtatgaacaacggttcaagatgggcggtatcctggacactcattcttgtggtggtggacagcaacgaaacaccgtggtaatcctgacggcaagctgaatgtgggagttttcagaaagctatggctaaaatatgacagtaattagctagcatagagccgccaagtaacagattctttggttcgaaaaataatcattctccttcgatgattcagactaatattccagagtacagggaagcttgggatgctgaagaagacgacaataacgatacccatttcttaccaaccattgtcagaggtagttttatatttacatgagaagaaagcgggtaatagtcagcttccaacagccctagatcacttgtaggaccaaaacccatcgggttatgcgatgcaagcggtctcagaggatcaactgtacactcaagaccccttcgtagtgcattcccgcccattgcctcccacctccaatgtctaactctgtcgaatgtaacatcctgtacttcctgtttcggaaaggaatatcgtttgaagaggtctgtacatggaaggaagaagccttgtcggcctctgtatcgacacagatatgttcactgtttctactgcacgactggttgcaggcagtccaaatactgccatgcccctctaagactgcaagacattcttagctgttatatctgatcactaactcgagaaataccactaaccccatctaaataccggagacagacgtatactatatacattactaacacaccagtagttaattaccttgagtcaaacgggcaaggcgtttactgtactgttcttggacgagagagtctgctctgaagcgagcaacacgtgctgtcgatacaaacccacagaggagtctcattccaaaacagacagaaaaaatatgtgacacaagcaggccatgggtctcttgaatgctcatcttcctcttccactttttgattctccacactcttccagccgtacatcaaacctctttattagagacgcgctagtgtcaagacctccgaacctatggattggacatgtgtctggaaaaggggcgtatctcgggccacagtaacaggagaagaattcaaagcacaccactggactcgtcacgtgatgaatacttcatttcttctctttgattcgtcacgtgaccacttttaccccctgtagtaccggcttccagttaacttcgtcacatgaccaaaacacaagaacacaagaacatacccctcttcaggtatataaccacgcgtggggccgtcttgagactcactgttacgcaaaaatatgttttccgacctgggtttctcaatttctaaggcgccttctctggcagcaagggcagccctcattctgatggccatagcagtctcgttatcggccatttacttctttcagctcgtggtagtcggaggcgtgggatggttagtggttgggtaggatttggaggtcaagaagtggtggaggattggcactggctgttttctaatatttatttgtggtttggtgttagtatgatgcgagtcaagtgaatgtcaagtagaaatctaggctggggaggtgtcgtagttaagatactaattgagattagtcaactaaaaaggcgttaaataaattaaataccaacaaacaaatgaatgtatatgcagaaaaaaaacaaaacatctttcatctttacaaaaatctatctaaataggtgtggacaaacggctatcgttatagcggtctaggacactagcagcatgctaaaaactccaccactttgaccgtttaaaccactccaacgccagcttgaaccaccggcagcacatcaacacacctgtctcctgctgtcaatcaatttacgtgcatagtccggttgaaattgagaacgcggttatgtggcctagtttgggagcaaatataaatctgaaaaaaccagcaagcacaaaaatgtctttataaatacctctccgaagtcttccacctcccaaacagctcctctcatcgtttcccttgcagtctccgtatccaaaaaattgtgcatattatgcataaacatttaggttgggaaaatatatctgaactgtaatctggaaatatttggtgatttaagatcgagtttggtctttacaagagctcttcttgacagaatcgtatcttgtttggtatcattggaacgaaaataatgtctatattcttattaacaactcagtatgtttatagaaccacatttacagcttttgtgtcgaaaacaatgcttattaagcagaaagacatgcgattcagaatttgaccatatcattgtgttcctctcggtgtcaaaaatctatcgataccaaccaaaccctaatcatacctcaaaataacttagtatctctgggtcctcctgtttcagcacattcttgctgccacttggtcccaacgaaacttaaccttagcttgcgtcggcaatttttatttaagacgggcttgtccccaaatttcgagagcaccgaaagcataaaaacacgtcacgtgatttgagataacgagatcacgaatcggaaattacgagtgaaacgaccaaaaaaaacaaaaatcacatcgacacgaactgtgcgacagctacaccaccaattgctaaacattctacgcatcacacaaggacacaatgtctgaaaagcctcgagaaatcaagacgcgtttcccagttgcgcgaatcaagaaactgatgcagagcgacgacgatatcggcaaggtggcccaagcaacccccactgccgtggccaaggcgctggagctgttcatgatctcattgatcgaggagacgtgcaaccaggcgcggatgcgaaactcgaagcgagtcagtcccagtcacctcaagcaggccgttttggagacggagcagtttgactttctgcaggacattgtcagtaaacatcccgacgcggtcgctccggcaacgggtgaggaggagcagcccaagcgacggggaagaaagcctgcccaggagtaggcgactttaccagcttggccttgtacgcagtgccggtttggagagtccagtaccaagctcagtgcagtgctaaagcttttgtgcttctgccatttgaagctaatggtcaaggcacaagcatggagtatcgaacgatcaagaccaagtggtcgtcttgtgctaacgaaacactaatgaggaggatagacggttgcatgtgtattatagataatgaagactttgttttggatgtggtttggaaggtttgagcaggtgatccaataagtggcgaaggagggtatgacgagtgcgccatattctggtatcgtactgttcccatttctccaagacaacttgaaaaaatgtggattccgtagagccattccgcattggtaaagatgacaaaggtgctacgggtgtttgttgtgagttgatgtaactggtgtattggctccgggtatcagccttggtccctagggacgtctgctgcagcttgtagggaacggagtctgacagatgaggaaacaagagctcctgagtttgtattggtgaatatcccaacctccttttgttaaggaatggcactgattcatgggcatgtacatagttatatcccctctacatgcactgagtccagcacatggcgagttgatcatttggttgatataccaataactggatttttttttgtatcaatcgaatcagcttgaaaatagtaattgaatggtctaacataatttacaatatgtcatagtaacactgccgcaatggagtgctgtcattcgtattggtgcaactatcgtgcggctcacaattttttttcggcagccttcaatgatgacctctacaacactttttgggccagaattttcgattggcagactgaaatttcatcgacacaactatgatccgttcaaaatcgctttctccaacacttttccacctctagtcaatccattccatgccagcacttgcacctctatcagagttgtcgtgcattatcggtccaattttgtgtgtatcggcagaggtgtgttcgtaactgagcagaaggaagaagcagaaggaaatgtgcattgatactcatctacattgtagcttacacatgtctcaccatctccttgtgtctcagaataagcggctgcttgagttatctggctgaacacgggcaaacgaaggcaaaccacttctggtttagaggcagtagtctatgtggagatcgtcacagcgacttaattatttcgtggagtttaccatgggccgaggttgctagtatccgcactgtgctcttcgaaacgagggcttctgtaatgcgattttgaaaaaacacggcgaaccaaaccaagaggctctgatgcgccattttcgaaaaccgccgccgtcgttagtattaaattactgcgagggcaacaccctgtctcagtctgatcacacgtttcaacgtttctcttgtttacagtgaaatgcgctgtaaacttctgcaaagacgctaaaaaccatatacagtatgtacactagcggctaggaggaatacggaggagctcttggaaagactcaaatttgagactatttcgaaaaaaaagtagacggatatattccccgccccgagaagatggccaaaacatactcaattacggtctttggtccagatttctgagactaactcccccatcgccaagacgttccctgcatcacctccacctaacgaaaaaaagtaagcttttgttacagcgtataacgtataagcctggaaggaggtcaaagtgtgtttccagccaccgtctgcacgtgggcttttttgagcttttaaccggcgtcaagcttgctgaaactagacaattccacacttgccgctcttgcggattttatggcattttttccacatttttccgctaacgccttgcccctcaattgtataaatccgacgttacatcatgcggctgggcgaaatggctttatctgtgcagtctttgctttttgagcagccagacaacggccaaacatcgggttcaacacggctcttggtgagcccttccttcccaaaaaaacctcaagaggctcgtaaccagtgtacacagcaatttccgttgtcacacaatcatttctctcccccccattacatgtacttggccgactccagtacccctccccataaacggctcaccacatgaatggataaaagcatgttcttatttaccactctcttgtgccaccacttttttttctgcccatcacgagacttgctcaaagtcattttgcgggaaatgcactttagagttgatttgagggaatcaaaagagtcctacaaagggcggtcacgtgccccgaaactgcgggggttgctgtccaggccatgtgacgtctccaccatgcgcaaatacctcacatggtcaccgcgtatatgataaaagtcaatagattcgccgcagcggtttttaatttcggctcaatcgtcgacgcagctttaaaccctatacaaagcttggtgccttgagagaattcgagcgaagcacaggtgtacaaagaaaagggatatttggaatttgacaggacggacgttctaacacgacccagacaattcgattgccgttttcagatttcaaaaagagccaaaagccagcaagttagaccccctctaacacccccctaaggctactctgctcatgcggcaccaaaatgtggtgtttgggtaccgccaaaaggaatcaaaaggcgagaaaagccagaaaaaaagaacggagacggaatatatccagtcacaaaaggcaggaatggggttttccgaagccccagcgaaaaagcaactcgtattccgaccgcttccccaattcggagatgaccattgacattatcgtagctataatggggactgagttaaggtggttttatgcgggattttcgggacatggcatttgcaaggcgacaagtgctcggattcgcaccggagttggttcaatcgatagtcccggagacccacattctaatccgagactcaacccactaaatacccgctgcctcgccctccccactgctcccatgttatctccatcatccggactttaactctaactctagagggatataaccgtcgacgatactaaaggcccgttatccgtcagttgaaccccagccgtggcaaaagtgagtatgttgaggagcgtgctgtgtgtggcacgaaaagacatggaataggacacaaaaacggcaacatggccacagacaatgcagttatgcgacgcgcgacaaagacagatctgacttgggtcctacaagatgggattagtggtgggctggtatggagtgagagggaagaatgacacaggcggacaagtggcaagaggaggtgcggcagactcgaatggctgccgtgtggctacagcttgagatttcgtgtggaggtggagtgaatgctaggtatggttgtcactctgcacgagctgatactgtgaagaacattatgatacttactcttaccctgtgccaccggtcatatcacttatcacctattattctctcactacttctccccactctcaccattagaccacactaatgccctctcctgcacgctaatgtcatgctgtagtgtgtgattatgtcagggaccagactatgcgcttggcaagttgacgcagttgaccggaaggcaggtaggctctctactattcttgtggaaatgacgagctttccgccacaacgaaagtgcttgatctggaagtcatatcattgcactttccacattcttcctcaagcaggtgttctggctacaatgatgtgatgccagtttgcgtctacgaacaggcttgttcattgagtcagtcagagaccagttgtcttgctaatgttatagtagtctgatgttacagtagtcttctgtgtgttgtccgcttggtacgatggcacttccccgtactgtactaacccagtgattcccacatccgaactcgaccattccgtcgaccaccaaatctccaccgagtaccgcgctaatggcgatcacaacccccatttcaatgaacataaagaccaccaccaccccgaaggggcagagcaagggttcaccgggaacctcgagctgcgttcggacgaagacgtcgaatcggactcaaccatgagcgacattgagagcgaggaggagctggaggacgacgagtttgtcgaccatgccgaggaggtgctggaccgtcagaagcatcatgaggacattattggtggggtgcaccagattcaccatcaccaccaccatcactaccatcgacacaagcccgaggggaatgaaggtcgagggcgcgaaagtctgtctccggcacgatccaccatgtctatgggtggaagcatgccggacggtgaacaattgtctccgaaagcaagtgctattgcggggattgtgagatcggacaccaccgattctcgccgagaagactcacccgacatgctcacccacaagtccaaacacaagacgttcacgtttggcatgcccttctccaaccctctggctaataaggagtccaagaagggcaagaaggagaagaaggagaagaaggagaagaaggagaagatcaagcgagccgcaacgtttggctctgtcttcaacaaggaggaggacgaggctgagttggccaagatggactctgccacccaggccgagcatgaatctgttgcccagatcagacagaagctcaaccgcaacctgtccatcaccaccgaggaagaagacaagttgttcggcaacaagcacgatctacaaagtgtgcgtgtcaacaagattgtcagcaacgcgactatgccaactgttttggactccatgaagattggaaacaaacagaagctgtccaaacacgacgctttcaacgctctggaaggtgactttgttattctcggtggataccgaggctcagtacttcgagatgccaagtccaagcgtagggtgtggatccccatcaaagtgggtttcaatctgcgaaagattgatcttactgttgacacttcggacgattcagagaccaacatggagaagaagatctaccccgatggcatgctgactcacattggaccgattgatctgagtaagcgtctgatacagaagatttcatacaaccccaaatgtcgcattagagactttggatacgactggcgtttggactgcgggctcaactccaagaagctcattgagttccttgagaaaatttacgctgaaaacggaaacaagaagatcaccgtcatggcccactccatgggtggtctcgtcacccacaaggcaatgctcatgcgtccagatctgttcaagggcgtactttatctcggctccccctccgagtgcccggctatcattggacctatcaaaaacggagatgccgtgttgttgtcttccaaggtgcttactgcccagatcaatttcctgatgcgatcttcattcatcttcctgcctgaagacaagcagctatttgtggacaagaacaccggccagcgaatcgacattgacttctatgaccccgagcaatggaagaagtacgctttgtccccctgtgtctccgaggagcaccgacaacgatgcctgcagaagaagcgacgaggaaccgagttgtcaaagctcaagccttccaatctgagtgaacacgaacaccaccatcatcaccatggcgtcggagagaagctgcacaagcttgctagtgtgattgctcacccccgagaacacaaggatcactacgagaacatgcatcccgaggccactgcctctggagctgatgctatggctgtcgctactggccattcaggtctcgttactatgggttcttccaccggtaacaacgatgccaacatccccactattgattacgatgacgcctgcaactacctggagcgaactctcaagcgaaccaaggaactcagagcttccttctggtatgatgagaagcgaaaggacgagtatcccccccttgcctgcgtgattggaaccactgtacccactctcaaggcctgcagagtcgacggctttgaaggcatctacaagggcgacttttccgactttgtgctaggatcaggcgacggtgtggtctactccaagtggaacatgcccgagccgtttggtttcaaggtcgtggccaaggtcaagaccaatcggggtcacgtgtgtcttatgaccgaccacgttgctgtggctaaggctctgatagctctgcaggaggctgctgagaagcgagagaagggcgagccttacctgcccgacatcacccctgtccactccatccccgtgacagacgatgactctggagcaagtactcctgtccattcacagcccgtcagcgcccagaatagcccggctcccggccatcctccccagttcagctcgccgctgaagtattcggcatgatacagggacacattcgttgatagatcagttttgtaatagtaatatatatattagatgtgacaggcgtaatcagcacatatatatatatatatatatatatatatatatgaaatgcagttgtcgtatggttgcagcatgtagaaaaagcaagttggtctacaatccactcggaatctccggcaactcgttcactctaccccctcaacttccgaatcaacccagcaagacgagaaatcaacaacatggcctcctggtctcctgccatgacatgcacatcgccaataatatgtctcgtcttccgatcaataactcctcgtgatttgagaatcttcaacagcggattcatcagctcagtaccacacgccataccaatcatctcctgtaataaagaataatggcccccaaagtgggcatggagggcatccacaggtgtgtctcgagccatgttttccatggaactgatagccgaaatcggaggctgcaagtatggtttagacatgtcaccatccggatggtcctccttgggaaacggcttacggtcaaaataccgttgtcggatgaaatcattgtactcttggaacttgcttgacacgggaccgggtccagtgacaatttcctccatgtctcgagactcattattggcaccccaccagatttgctgggtgataatggtgttgaaaagcttcatcaacgagtgcaaaagagccatccgagatactcgctttcgagtagaagaaggtccctcattcttgttgagatcaaagaaaccggccaccagatccaactcacagtgaggagcagtagagtccatccagtgctcaacagtgaggaagtcaacgaatgaaacacgagtggggtgacgtgataggttgtaaagacgcacgatattctcttgggtggcgtctggtcggtcgtctccggacactatggtatatgttgcaatgagctttgagtgggagatgtagaaagacgtcgatttgatctctgagggttctgggtctcgttcgtcacaaagcacgaaaaactttctccaagccttttgcacagcattcggctcgattcctgtctgagcagatatcgtgtgtttctccttgtcggacagatcgtcctgaggtggatcgttagataagacgtgagcctccatgtgattggtatcagaatcattcttgtcacatggctcatcacgtgacccattagtttcctcctccttgacatttgttctcgtaatgacgtcattgtcgcatccagtccagccctcacatacccattggggggaatacttcaagggggcagggatcttgatcttgataagcacgtgactccattggtgcttgcgaagtacaacacagtattggcacagatccacgtccacgcattcgctgcaatgatacctggttcccactattggagacgtcccacatccgtcacaagtgatgcctcggtgcacaacgccaatgttcttggagcatgtttctgccaggtggtacagaagcccaagaatctcagagttgttcgagggatgcggctgtttgaatagatcagctaatgacgtcgatatgtctgccgtagacagaggtcgagtgaatggtctgtccatgtgtgtatgtggtttgatgcgatgcggttgtagttgttggtatgtacgtgtgatgggttttgtattgcgtgagattgtgatgtgtttgtgtaatgtgctgcgattgtgtttaatgagttgaatgcatcggtgtaacagcagaatgaatcaatggatgttgcaatatggagagttctagcgggagttgatgtgagaggtgatgcagtctaatcataacttacagtacggtatatactgtttggagtgtagtttagaagaagttcatgggaagataagagggagagaaaggtgacaggggctagaagcgatctagtaaaagaaatatctctctccttttaagtctcatcaaactacttttaccaatgccttggtgaatttgtatcttgagaaactataaccactttttcggagtgaaaaactggaggaattgtgtccaggagatctttgcaatcaaaactataccaaacactaccattttacttggaatattgccaaaatttcggtgtaattttcattaaagcccaaacccatgctgtggaagtgtattgcgaaatgtcgattacataagcacactcagttagggctgacaagaatgctccctttagtgtcgaaatgcttgttcgagttcacccatattgatatacatcgactgcggtaagtacagaaacgacaccagatttcatttagtccaaaaacatcaccagatcatcttccagcctcacttgtaacttctcacaaatcacgcgatctctaggcaggacattatgccatggcagcagaatgggaagatctgttatgaattttgatgtgaaagattatcaagcgtaaataaacacgcgattgagaactatctcagctttcagttttcaaatccgataatagttcgattttatatgtgttattttacaattattattttcctgcactgtgaacctcacgatatatcacgataatcaacttaattccaaaaaattcgagaaaaaatcctaacgaggacatacagactaaacaacgcgaagggtgatatatatttcatctaaaatacattaccgtttaccaattactcacaaatcatccttaccgcctagtcaccctttcccccaagttgccagtcacacttcctttcatcctcttatgaaacagccccaaacaaaatatataaaacgggaaatgtccaataaatgacgccggaaacctcaccattcgtccaaaaatgtcaccgccataccatatgacacttcctctgtcgcaagaaagtccagccgactcacccaagggagactcacggttctctcgcttcttcaagaacttgcgaggaaacgagtccagagaaagcattgccacgcggaaatcaagcgttggaaaacagcctcaagtgcattttcagtcgacggaattcctctcccgcgactccccggactcaagcgagtcacgtggtctccccaccactccagacgtggacatcaaccagtactttttgcagttcaacaaactcacaggttatgattctaagatccctgagaagccacgtgacctggatacccccgaacagagaggaatgcttggtgtctatgaggactttatgcgagcccagagaggcacacaatggagagacggagacttgggtccgatggaaagagaggccaaactcaaggacgattactcagctcacagcagaccttcagatgacttgaaaatctcaccagtagaccccgagtcacatgatctaggcacttccagaccctatgattggtcacgtgacgtcgacaacgctacactgacccccatgactcctcatgttccctcttcgtgctacagtatccacaaggagaacccctacctggagtcacgtgatgcatcaagagatggagataagtcacgtgaaatctatgactttgtcaccaagtctgatggtagttccaaaccgcggggttacgacaactgtcattctacgacttctgatcctccttcgcgcgcgtccagagcgtcacgtgttttttttgcactcactctgacatgcttgctcataattctcaagacacgtgtaacgaccattattctcaactatggcattgaagactcccagatatactctcagactgcttgtgctactcttaacacctatgccgccaccactcatttcggccccaatcttctgtacagtgcaatcacgggacaggcagctggttatgtgggtgatatggctcagggtctgctacccggcagcgatgtgactatgaggaccccagggttcgtggatggcttgttaagtcaaatgaagcaagactatgtccacagtcttacacatactattgattttggggttgatctgaccaagaataccacctccaagaatgcacgagacgctcagaagattctttcagaggagctcaagcctcttcaagacaatatcaccctcttcgagacctctctcaattctctttctgctaatcttctcaaaaatccaatattcggctttgagaagtcaggaaacacttcccagctcagtctcgatagactcaagaacgtgaatttcagtgacattttcttctcggacttcctacctcatttccaatcctcttttgacgtttccaaatctttccaaagtcccttctcttccgccaaagatgccattttgactgatctcgacaattttaacaatggagtgaggaagctggcgctcaatttgcccacagctaaggctgttgccaaacagctggacaattcgagctacaatcagctgttttcaactttcaagctgtgtaccaaagaggatgagatcaaagaacactacgagaaaatggtacagagcatcaattcaaagagcggagctgttgtgattctgtttgtcgtttttgcagttatctttctgctcatcacgtgtttcctggagttgtttggtttgacccgaaagaaacagctccagaaggtgagctacctaagaaagctcaaattgacagagtcccatgtggaacccacccactcaaaaaacaaaagccacaaacctcgcgactttattcccttcccacaccacctgtctactctcactatcgtcactgttgctgttgctgtgtcttgtatttgtgacctttctctgttgagcagtctgaggatctctgggggagctcagatcgagtttgtcagtgacatgtacgagtatcccactgataatgtcccaggcagtgtctctgagaacgtgagtgagcctgtggaacatgtgaatgaattgaatgctagagatctagagtctgaagacgacgcgaaaccattggggtacactgctgtcgattacatggctatcttttccacagcagacaagccctctgccactttggttgagactgctgcttctgttgctacgcctgttcacatcacagacctcacgaacaacagcattgcgactctccacaacatttcgtcagacattattagactagtcgactctgcaaacatctacctggagggcctgcagaccaatctggaaaccgaatgtctgtcttttcaaagccagctcctcaagggtgtcaattctacgctgatgaaactggagaaagaccttaacgaagccgtcgcaaaccgatttggatttgaaagaggagatatcggatctctcaactctgacaagttcctaagtgctatcttggataaatctagacataaagtggctgctggtacagccaaactattcaagatagactccaaacaagcagttctggcattcagccaggcccatattaactcacttccgggcttcgcccctcttcagaccaagaccactattgctacaagtctcgagaacctcgtcgacatgatgcagaaggtggtattgagtcagcagtggtttgccctgggacttttcattgtttggattctgatcatgatcattggaggagtgaggtggattctcgcaatcaaacgagaagtgggttttatcaacatgagggtcaaaagatgggaagtttgaaggacaactatggagtatgatttttatgtttgtttatcaaaacgagacgtagaagatttcactatagagtaacaataggagaagaaatactcgacaataagttcgttgagaaagtacacacaagttcaagagcttccattaaaaatattaaaaggactaaagacctttatgactttcagagcttccttaatgagtaataaagatacctagacttgacattattttaatattttaatattttttattctaggaaatagattttagctacttgaggtctaaggacaatattatacccgcaaatcggattcggattcagttgttcagaagagggaatggcatttgtgttcgcttgttcacgtattcttcctgttccttctctcgactttttaatttttttctatatttttttctatattttttatttatcctgatgattcatttttttttatttattctaatgattcattacagctatatacctacacttgtagtaagccgggttattagcgttcaataaatcatacacttctgaatttttgcgatgtgcgctgcggggcgctgtcggttggtttgtcgacgcttcgtctttattatgtaatcaattttctgattgcactggtcacattttctttgaaattaaaaaatgcctggctagctcaatcggtagagcgtgagactcttaattctaaaaagcaatctcaaggctgtgggttcaagccccacgtcgggcttatttttaaattttcaacttctcaaatgctacagtgtattgaacgttgcgcatcacttctttttggaaacaaaagaatcataaaaattaagataaaatacaccagtcgccgccaatccatctaataagtacatacaggttagttaaacatctcttcttcctcgtcatcatcgtcttctggcacaaaggcctcgtccttatctctcttctccttttcttcggccggctcaggtcgcatagcagcagcagcaacagccacatccaccacattgggttccatcaagatgtggtcatcgacagaattggtagcgttctgaacagcacgcatgagatcctcctcgttgatggagtcgactgaaagatccatcatagacatatcatcgccctcaatgggagcttgctgcgactgctgcgattcggaaagctgttcgtcgtgctcttcgatttcagcttccgcaagagatccaatctgagcagcagcctttcgctttctacgaggtctgagaccgtcagcagcagcagggtccttgggatccacatggccctcgtcaacagcatcctgaaccacggtacgaatgagatcctcagccttgagttgctcagcctcgtccttcaacagcttggtgcgtttctttcgagacttcttgggggctgaagttgtaggggcagcaggaagagacttctcagactcggcattgggctcgtccacatgaacacgcttgctcttgagcggtttaagaggataccgagagccttcagttcgaggcttacccttggggttgtgattgttgtcaacaacggttcgaatcacctcctttgcaccatagtattcggggaacgacttagtaaagtgctctttgaaggtgacgtggtcatactcctgtttagcgactcgaacctcttccaggtagttcggcttggatttgagaattcgcaaagagtcactccaggcgtgtcttgatcgatgagggtacaggctgtggagtttcatcatggcagccacaggagtcttttccgagtgagcgatcgccaggagagcctttctctccttgtcatccagtcgcttcttgacgttgaatgctcgagaacgggtatacagctcgttccaatcaacagcctcctttggtttgctctgggcagagatcaggaagtcctttatttgatgccagtcaattccataggggtagttgtgacgctggaggcgggcgatctcgttctgagacatttcggtggtgatagtgacgagtctctgacgaactagctcggggtctctgttcaaaacatacgacaccgtctgaacaagcacctcaatggtgacattgttttctgtggcggtcttgttagctgcgtaaatcaccttatcctgggttcgggtgaacttggaggtatcataaccagagggcagggtctgttgaggcctgggaacattagcaagcacctcctcaggttcgggaatggggttgggaatatgttcggggataggctcggatggaggctctggttggggctcttcaacaactgtatcttcttcaccaatgatgctgaacttattgtccttgaacctgtaaacatcgggatactgctccacaaacagctcttcactttctcgttcgctgaaacgagctgcagcgattcgagtggttttcgaaacactgcccttgtctgccagcaatctatagtatctcttgtgccactgctgaaggctcttgtgcggatactttcgatgaacagctcgagctccatcgaaaatggtagcagctacctccagatgcgccatcagacatcggtcttcgttggtcgagaacttgccagcctcccatgacacagcctcggtgatttcgggccatttcaggtctgccaccgtcgagttttcgtccaaattcatgattgcagattcgaattttggccaatcgacgttctcaggcaatgcggactctttgagcgcaagtgtgaccatctccgactcttgtcgcagctcagccagatgtttcctgatagtatagggaccgatcgaaagcacaaattcaagaatcttgagcaacaaacggtcgggaacgcgcttggaggcaaacagggcatttgtgtctagaatgaacttgtcctcagagctggaaaacatggtctggggtccatcggcgtctccttcgtcgtcctccttgtcatcttcatcaaaccacggtcgattggggtctgaatttgtcgaatagaaccgcgggaacttttgttgaaagtatgcgagggttgtatcaagaatgaacatgcgctcagcgtccttcattcgagtctccagctgttcaggagaatactggttcttcaacagcgtgtatcggcttctccaatgtttcttcaggcgatgcggaaactgctgtccaagctggtcgatggcatcgtgtaacgacgtactcgtgtacacgtgatatagcaacagcacatcttcaatggggtcaaacttggcccacacattatctctggagttggaagaagcccgtagagcgctccagtttctgtctgagagaaaggtgaatagcgactcccaatcaatcgtgctcgggtaccgtgcgtgtcgtattcgcttgatttgagattcgtccaacccgctcagatagtccagtctgtgtttgatattgtcgacagaacggttcatggtatgagacagcgctaaaagcaggtcattgtcggagaccctgcctgtctgggccagatccttggagtcgatgatcacccggtcataacctctggtgtatggcagagacagggtcgacgaggtgttgggttcagtcataaggtgtcgaggtggttctagaggaaaaataatactgccgttgggagcactggattctaatgtcctggggtttttttttcttcagtaatgtagtgtggcgttttgagttgcgaggctcggtagggtaagggttgagatcggacgatgcacgtacgatcacgacagctttgagttggtcttaatctgtgctgaacctgccgttttgcgtacgagttttgcggttttttatgtttctgacgaaaagaagcaaaatctatgatcttttctgaccttcttctggtttatatgtctcggaattatggactgctcgtatcgtgcaaaagtatgtgcgataaaaagtggtagtccataaactcaacaatctaaactttatgccatgcgggttggggagggaaccgctgtagtgggcgctataggccagttggacctgatattttttgaattgccattctctgctgctttccagatgtattgacaagttttcagcgagttttaccgcctctaccacccctttttcaacctccctcaaaactgctgaaattaacggaactctaatttaacgactcgctcttttgttagcacagtaaaacatccagacttagcaagtggcaccatcttctctttggcacttctccgcggcaatgcacttatataacggtggtgattcggtatcgaaaagagcgcaacgaactcgggcttcttctgagtaagaaaatcgctgactagtgataaggaccaggcatgctgctacagtggccggtctctgacttcagaaccatggactactctggtatgttcccatgtgcccttatcaaaacggaattacctcccgcgggtacagtacccctgcttagcgcaactcgtattcgacaatttgatgcgtctgaagacgcccgaaaactcaccttttgtggcggaacatttccccgaggttactcactagtgcgggtggcaggttgcacgctacttgtactcgcagttgccgtggggtacagtacagtccgaggtcgattgggtttaaggagttgaacctgagtgatgtatggtgataaaatggatactgggccatcacgaagggtcgaacacagcaggtgcacttcagcagttgagacccctgtcgtatgtgtgcattgctgccgggtctgctctctggaatgtctccagattattcgagtctagcctgcaactaaagcgctcacatgggttgcgactcttgtggaaagcaggttttgccgacattagtctggggaaatgtaggcagacgttccacgctgagttgcgtgttgctgcctatgtcaggagttgcgaatggctttttgattaaaacttctccggggctggaccaaggtcacatgcacttgtttcagggcaatggtgatatgcgactgtctctttggacgggtgaagtgaagttcgctttcagaaattgcttttcgacagctgaaagcggagaggaatgagaactcttgaggcacatttgactgatgctggtaggggtatggtactacaatcagtagaggttcatcatctactacacattaccgaacagtacttactactcgaaaccctcctatcaagttccagtacagtcgcgtaacaaaataatcagtgctttctcgagagactagcctctgcctacaagtactataccgccgagagttgtttacaagtaccagggcagtacagggttgaaatattgaaggattataagtactgtacttgtacttgtacacgacttcgatttagaacattgttaatgaacctcacgctgagataacactaccaacttgccgtatcttatatccattacacccatattcgtctcgaggaagaacatgacttctcgttacactacagattgaactgcaacagtatcccctttatctgttccaattattggaatagttgaattggaactctttatctggtaatagtcgagtccctaagggaagatgtttacatgtctacagatcatgatggttcgctcttgggtcagggaaaaggacatgttacatcaatcaagatatgttacagtcatcagtaacgacatataatctagacttgctcagttcagcatcctttctttgatagatatattttggagatacaagataccgtacctccaagcagtgctttcatccggacctcttgctaatcaagagagccctaaccaagggagcgagaccgcaagcacaacacactacaagcacaaatactgcaagctacaaatccctcacgagatccaacttctcttttatcaccctatgtcacacctctatctccaagtactgtacagtaactacagaacttggagatatagaattacagaactactactccaaccactccaacaagatatgcaagattagctctatttggtatgaaactcagacctaataatcgtcatctgactgggtactcaggggagatagcagggactcttggaggctatcaatgagaaagggatagttctggaagtagttgaatgtagttagtaagtcgtttccccttctctctatgcatttacggtctcgctaaggtctcccgttcttccccacttggcccgccctctacactccctacactcccaacaaagatagttacatctcaccttatcgttgcctggacggtaattaaactttgacccacatgatagtgcatcatggcacagctgcagacccctccgaaaacaccaccttcataacctgacacacaacacacaacaacacttcccgcatctaatacaccgcttcaacacatgaactggatccccaacgtgcagaagcgggcgtttcactacgtgctgaaccgcctggcgctgttttcggacctggagctcgacaatatggacatttcgctagggacggcgcagaaggcggcgctaactaacgtcaaactcgatcccgaccgtgtcagtcttccagcaggcatgtacatgcgctctggaaagatcgacgaggtgtcggtggagatgcggcttttggggggcgcgggaattgccgtcaagatcgatggcgtgcatatcacggcatccatgaaacagatggacgtggagaccgccaccgagcacgtggaggagtttctggaaaggacgacggctgatctggcggcatcaatcctgtcggaagacctgtccgcgtcactacagatcgatccagcagaagagccaccactgctgggcatgggcgggtcaggaatcagtgaggcactagtcaaaaaggtgacacagacagtgctaagtcaactgacagtggatgtcacaaacgtgcacgtgacgctatttgtggctgcagacgacaaaatggatctagttgtggacgaggtcagactgagaccacaaggaggacaggagatggccctggaagtgaggggagtcaagatgaaggtaatggacaagaaggctcgaggcacaagcgccccggtaacagcaggatccacagcacatgcaacaacagggttcacctcagaatcagattcagattcagacacagacccgttctcaaatgcaaagaagtctctccttcaatcaaccattttttcgcatgaggaggccagcagcatttacatgagtgcgatagccgagtctgccaatctcggatttgagtctgacccactctttggggtgttttacgtcgacactattgacgttctggttttcctaggagaggaaatgagagtcagttgtgaggtcggtattgtcagagccagtctcgacctgttgccgactgtgattctatcattggttaaggtgggaaatggtggaagtggtggtaagaagtctcgtgattcagaaacaaaagaggggactgctatggacttgaatatgagcatcaagtcgatttcggcatcgatttgccagttgggtgacgactgggagtttaagaacattgacacaaatctgcttttctctctctccgatatttctggatcgtctggagctttccacaagctccagattggtgtttgtgaggtgaagaggggctctactcgagtgtttggcttcgaaagcgacgagaagaacacagacgatgaggaacccacaccacgagattccgatattctcctcaaagcctcttcggcttctttcacgttggttctacccaagaaggctgttggcgtgtttaccatccctgatctcatcgacgtggttagcttgattacttatctcttgtcgttaattgagtccaagcagcagaaggcggcaactatgactgaacgtagtgaaagggccggcgcatcgaagactactgttcaaaccaacacttttgatttcgacgtcgccggacacaagctgtacattttgcctattcgactatctaacggccagatgtcactatcacgtgtttcgttcggcgatgttcatgtcaagggaatttcgtttgagaattctatcgtgtcggttgacaaggtggattttgatattggtctgccgatcgttgaggagctccaccagctacttctacctatcatcgatgcgatgaacagtgcaaagaaccgaccagttcccgcatcagtacagaccgcaccccccaagctgcttcggatcgtcgaggagcctgtgaatgcctcctctctagtcatcaatgtggcgagggtgaaaggaaaggttgatctaggtggaaaagtcggggtcattgaggtagttctaggtgggatttctgttactggacctactgacaggattgagatctccaccgtcgaaatcggaagagatttgagcgatctgggattatcaaagaagtggcttctgcatccgcttaaaagagtgagtatcaatgcgtgatggagtattgacattttacatatactaacacaggaaagtaatgttgtggtggagctctccagcggtcagattcagctcattacggtgaagaactgtgcacttgagttttacactgagctactggagctatttggaggtaaaggtgatgacaccaaggcagctgagttgcaagagtcatcttcaccagactcgagttcacgtgagtcctcctctggctcggaatcacctcctaaaagaattcctttgcagattcacaactgcgccgttggactgaatcctacaaactcatcttcctcagcccagttcattgtcaagcatgtgacatgtgaaatcaaaccatcacccactttctccatgacgtctttcattggatcagcatctcttcttttgattgatgatgcatcactggttacacctaatcctacggatctgatgtcttcctacctcgaacagtacacctctgttgctagcttgactgctacgtctatctccatttctacttcgcctggtaaccccacctgcatcaatatcaatggagatacagtcacactgagcacttgcgcagattctacacagactcttatccatctgatcaacagtctgaagccggctgttgaattgagcggtgccaagttccagctggagactctggacccgtttctcaacacattccaagacgtggatgactgcttcttcaaggcgaaaaacaaagacgcgtgtgaatcgtcttgttcctctgataatgacgacattgatatggtgtcagacgatgttcccaacaacatgtcttttgtagagagttattatgggggtgacaagccgagtcagagtcgaaagagtggacgtcaaaagatggctgaaagctacactcatgctgatttcctccttgattccgatctggatagtctggtgaagagggagagagtccggttcgaggagatctgctttgaagaggattatttcgataaagaggaggaagacatgcccgtcatgagccgtcctcgtgcatcttctcatgatctagcttcttcaaatgagctactcacaccgcccacggtggttatcaacattgacttgattcacaacattgtctgcaactttcatgacggttacgactggcagtacacacgaaatgaaatcaatggagctgtcgacggcctcaaaaaacgcatgaaggagcgtccagtggtagaagagccacccgtaatgaccaccgacctactcttcaactcaatctacattcaggcaaaggacgaagacgatctggatgatgttgtcggggaacagactgagccagccaaaccgaaggaggccaataaatcgcgacgtggacttctttctcggtcaagtaatcccctagtccaggtctggctccaaggaattgcatgtcttcttactgtctatgctggtcttgaagaccccgatcttcctcctggccaggttctcaactctctggatgttaaaatcaaggacgtggaaatcattgaccatgtgccaacgtctacgtggaacaaattcctgacgtacatgcgatcacgtggagaacgagaagcaggcgcagtcatggctcacatcaccatgcaaaacgtgaaacctgtttctacactgtcttcccaagaggtgatttgtcacgtgaccattttgcctctccggctccatgtggatcaggacacgcttgactttttgacccggttcttcaacttcaaggatgtgcgtaccactgctcccccagatgaaacgttcattcaaaagtttgatattcgtgatgtgcctgtcaagctcgactacaaacctaagaaagtggattattcgggtctcaagtccggcaaatcgaccgagcttatgaactttttcatcctggacgagtcggacatggtgcttcggcgcatcaagctgcgtggtatcaccgggtttgctaatcttggccagaagctgaacgatatctggatgccagacgtacgacgaacgcaattaccaggagttctggccggtgtggctcctgttcgtccccttgtgaacctcggaggtggaatccgcaacctcattgttgtacctgttcgagagtacaagaaggatggacgggtggttcgttcactcaaccaaggagcatatgcatttgccaagacgaccaccaacgagctggtacggtttggagcaaaattggcggttggtacgcagaatttactggagggtgtggtgagtacagaacgagcgggcgagtctcgtgatttggacgactcggatctcgagtccacaaccaagtactacacttacatgggctactccgactccaacaacaagcttatttctctatatgccaatcagcccttgggtgtgtatgctggtcttcaggatgcatactcttcgttcggcaagcatatgaatgtggccaagaccgccattcacaatctgagtgaagacatatctgaggcagacacggccggagcagccgcctacgcagtggtcaaggctgcccccgtggctttgatccgtcctataatcggaactacggaggcagtttccaagacgctgtttggagtggccaatgagatggatcccagtggtcgagagcttgcccgcgataagtataaggaggcaaactagtatataggaggaatgcatcggcttattatcttccgagtacagtactactacaatcgtagtacagtacagtgtattatacactgctgacgatcgttgttaggcgtggctgatgacgtcaaaacaagcttcccccacttccaatcaggaattattagtcgatggacaagtgtaattgaggaggttggagcggtgaatacgttccagattcttcgttgatcaaatattagggcctgtaactctagattcatacaacaatcatttccatcgctctactaaaacactttctagggtcgttagtattaatccatctatccccgccgacagccttgtccggaaactcaaatgtgcaccaaatcatgcactccacatcttatctcttctgacacatcaccacacgaaatacgacaagatgatcaacctgttcaaaggccaccccagcgacgacttatttccggaaaaggaagtgttggccgccgccgcgtcattgctgtcacgtgaccgcccggaagacgacgacgacgaaaaccgacatccccttacctatgggcctgatcagggtgctttgtacgtccggcagctgatcgccaagtgggtcacggagcgggagctgctggaaaagactccgattgccgccaattgcattaatctcacctgtggcgcttcttttggttttgcagatattctgcagtcttgcactcttccccagactggttacactcgacgggcattcattgtttcgccgtgctactacctcatcaattcggttttcattgattgtgggttcaagggcaaactgaccgcaattcgagaggatttcggacgcctggatctgaccaaactggaagcggatctggagaagtactcttccgaggagggccatgaacacgaaaagtcacctctggacgttgtgggagacgaatcgcgacccaccaagaagatttacaagtttgtcttctactttgtgcccacattcagcaaccccggaagtgcaatcatccctctggaggacagagtcaagctgctggaactcgctcgaaagtacgacatgctcattgtgtctgacgacgtgtatgactttctggagcactcgattgagcgggagaatctgcctcccagaatggtcaccctcgatcgtgagactgtaacctctacccatggaaacacagtctccaacctcagctgcagtaaactactgggccctggtctgcgtgttgggtggcaggagactgctaccggcgctctcgccctccaactggccgattccggtgcctctagatctggaggtacccctgctcacctcaacaccatgattgtgggcgagatgattaagctgggtctgtttgataaggtcgttaaccatctcaacaagatttacaatgcacgagctaccgtctacaaggaagccctcaagaaataccttcccgaaggtacccatatcgagggtggcgatggaggctacttcatttgggtgactctggacaaagtggatgcgcgaaagatggttgagcttgccaaggagcgaggtctggttctggcgtctggagacaaatttgaggtaaatggtgatccccagaactggggaaagaccagtgtccgtgtctctgttagttatactgatgctgataaggctctggagggaatcaaaatctggggcggggtttgcgatgatctgatcaagtgggacgaggccattgatgtgtgttaaacgacaataatgagattgatttgccaagatcaagagagattagagcagtgcagcttagtagtacgtagatgtattcaataaatatagacctatgcttctcgttgcttacaagaactgaaggaaaaagtagtagtagaagagtatacccttccatacggatgccagttcagtcttgtagaagctgtacagtgaagagtcgttccaggctgtaaccccagattcactctcgacagggtatctgaagtagaggtcagctgcgaaatacaggtaggcagcagctcggaagccctctagggtccaggctggaaggaaggtcacgttcagatacagtgctacgagcaccgactccagaacctgtgggtataggaatgcaaacaggaaggcgtactttgtggctttgatttgctggtcagcagggtagaggcgtttgacaaagtaggcctgggagtatttgatttggtttcccaggaagccggtaactagattgagggcgctgatttgcaggacctttgagaattggttggaagggttgaagtccagacacagaaactggacgcccagttgcagcaaccaacacgcgtagaaaacgatggctgtgaatttgtggggagccatgttgggcgtccacattggaggtgtccagaaaggtaggattgaagtcgccagaatgagtactccctcaagagttgcattgagtgatgcgccttgagacacgagaaccaccactgcaattgcgattgatttcttcacttgcagaaagatgaagttctggatcagcccagctttgggtgacgatggttgaggaactgcgaccacccctggggctgaatctgttggttccgatggaattgcgctgtatgacattgcttaaggaggggacaattggtgtcaaggagttacaaagttctgtcggggaggtggcgaagataacagtttttgagttttgatagtgccgtgcgtggagaaggggtgcatgcgctctcttggcgggtgaaactacgccgaatcaggctgaaaagtagtattgatgtagttttatggtgttagagatccgcttgctatgtgccattcatacatatatatttatgtaccctgaagtaccgcagtggaatccttcagtagtattggggtggtgataaggataaccagctttctcagtatcagctttctcagtaccagcttacttgagctaaaatggaaaaaaacagagagattctcaaagagtccttcatttaccttgtgtcgatggctccaattggtactgattacctagtattgaatgtttgaaggtcttgatctattatgttttcatagtaggatacattttttcttgtttttctctgttgactgtgtataatatatagatcatccatctcagtaagtgttatatttatcaacaaatccatgcgttctcccaactacagtaaatataaacaatactaaattcattgctatacgtttacattattctttcacagcaaagttataattaaatgaatgtatatgcagaaaaaaaaaataataaatacattgttatgcatcaacattttatatacattcgcagaacactcgcgatccggcttttagtacttgcaggccttgcagccgcactttttgcaagcacaggtgtcgggcatgttttgggacgagcagcagcagttgttgaccaagtctcgtttgttgaagttggactcagaggagatggagttggagatgagagaagctccaaacatggcagatgagaatcccattgcattaatgtttgtgacaatggtagttgtaacagtggtagttgtaacagtggtaattgtgacagtggtagttgtgatattggtggttgttggatatgtttgagtggtattaatataatgttggctgctgtctatttataatcatcctctgctattatatttttgagcatgcgcactttttgcgatatactgtagggtcaagtttaacgttttcagcccttcgcgataatgtcgcttcttgcatacaaagaccgaacctaaacaatcctctcgaatgttttaggtctggaaaattgtcgctccggcgacatttctgtgctatttttaatattttttgacagtagtaagtgtttaagctctcacagttgaccaattgtctctgtaaaccaacgtcaatgcgacttagatgcctgtgttgttcggaatccgtctaggttggacccgtcgatgcatgaactccggattggcatcttctggaagtgtgaagattgaataaggaaaattatagtcgagccaagttcattctgatgactgctattacatttatctctaagtatcgcataaatcccgtaactcagacaataccggcggtttcgcttttggagatggaatcgccatatcatcaacactcttactgcactgcactgccctacgactgcccctttccaagtcgttctacaaagacgttgttattaatgtttgacttatccaaataccctcagatcattccaaatctgagctcttcacgccacagcctcgccacctttgtgtatcggcacttttcgaatcgtccagtgccactttctgcaagattcgtgcattctaccacggctgaatacaactttatcgtggagatctgggaaccagagttttatgtaataagagccgaattccccattctcttccttcacacatgcacatcagctcaatcatctctctggacctctctcaaacaaaacacacaatctatactaaaggaatttgcatacacaaggctcagagcttctctcatctgttccaagcccccagaccatgaacaaacacaatcgtgttgacagcttgctgttgctccaagggccgttgagaggctcaccagcacctgctcttgcaccaagtgtgcttgcgactcttgccaatgctaagttatctcatattctaatgtatcattgaccatattcgtttgatgtcgtagcaccttgtaacatgacatcagaacagttataacccctttctagatttacaaacggacttcagaaagttgtagagcaacttctgaggacttgtattctttcagtgatgaagaatttcgcgctataatgggcacgtttgtccttgaaataccccatccttttccccccgacatcatctttcgggcggttggtgtagtggtaacatatctgccttccaattagttgctagcaggtgccaggggttcaattcccctaccgctcatcatttttgccttctccatcgttatagcccttgtaattcttttgttggtggtattcgttgcagtcttcagctccaacgcagtctacttccagcaccgtccttcatttacactgtacgtaaaagtgttgtttgaagatactctttttgaaatacaaactcatttcccctttgaaaccatccgttcaaccctcaagtgcgggcggtctgcgttataggggtcttcgaaacacacgcaaggtaaactgtctggaaatcctgccattacacaattatgtctcagaattccgcatcggaacatcgccagttgttttcagcattgaatcgagcatgaaccgagactgtatgggagtacaatatttgagactgaaagactatatatccgcttgactaccggttgaattcatacatccaacctgtcctgcaccaaaaattgcacccattccgacaagagcccgatcagtaccagtagactgaaacgtcttgccatgtgtacaccttgctgtcggccatcccacatggttcttggtcttggtctagctctctctttgggagtgacatttaaccaacgatttccaaacccatcgagaagcagtgccagtatgtctagggccgaaacagctcccataacccatttggacatgtacccgtggtccagagaaagaccatggtgacttttgaatccgcccttacgattgtagctgtcaatgttccacttcgcgttcaatggaaggagaatgtctccagtgtatataccattagataacatgatacagtacagtagccacaattgaaggtctccaacatagaatcgtttggaacctgttgatcgtcccaaagatactttccaatgcactcaagtctcgaggaagtcggctgtcgctcaaaacgttcatgagaaagttgattatcatgcccgagttcagacagttctccactgtcgtctcttgggctcttaagttctgaaagaatagacattctccccaggacctgttggagaagcttcccgatggaagaaggactgcactttctgagggtaaaatgcagccatcctcagtgactgattggtacaacagttgaaacgtttgcacttcgtcgatggagcgatttttttatgattttttttgcagtgcagcttctggattggcactatgagcaccccagataagatcccagaaagatttggactctgaatactcttagttttcttccagtgaaagctgacatcattcaagctccttcaattctgtcaacatgatgtctcatgcccctcgacttactgtaacgcatagcagaaccaacatggacatgaaaaggtcggtttgttcgctgcttggttgggtgacatagaagtactgtatagtgtaccgtacatactgtactacaagtaatacttgtacagcccacggaaaagagagagaaaaaaaacatttttcgctgtccagaaagctcagagataccgcttctaccccagactcctttgtcaacaaaaaactcaacaaatatagttatttatacttataatttagccgctactaactgaacaccaactattacttcaaaggttattctttcacagcaaagttataattaaatgaatgtatatgcagaaaaaaaaaaaaaaaaacttcaaagagcgaaggaagcttaaaaaattgaagccatgcttcccagaaatgagattgctatccagatatttctgtagttcatacggcttcaagttatggcactcaaatgacccattcatctccttcgtaaacactagaaaactcgcactcgttacttgtacttgtgttaaatatatgctctagtccatttctctattccatttttcaaaccaattgtccctctccatgattttgacatcacttctgcttatcatccacactgagacccttcagtgcctgtcgcaaatcatcaacctgctgcagaccagtggagttattgagtgtggatgccttcttcttgtacatctttttgccaaccacagagtagttgtccataaagtcgtccatgatggactcaaagtcgtttcgctccttcttcatgtcaaattcgggctggggctcatccttggattcatcattgtactcagcctcgaccttgtcgaaccggtcgtccaggaatgtcaggccctcgtttcggaacagggcagaagaggtcatggagtatccagacatggcggttccgttcttggcagccttctctcgctttcgacgagaccgtcggctcatggcggtgtaggcagctccgtcgatttcgctctccacctcctcgcctcgcttcttcttctggtccttcttgaacttgtcaaagtcctgctgccacgagtactgggggtcaaactcgtcttcctcctcctcttcggcctcaacgtccagctcggcagccagaggctgggagacctctacctcctttccagcttcttcctccttgttacccttagaccgccccatggctcgggcctgcttgatggcctgctgtcgaagagcttcaatctcctcatcgttgtgttcctcctcaactgtgtcaaaggcgccctggatggtgccgacatcactgtagtcatcgtagtagtcctcatcgtcgtattggtcgtccagagcggcctcctcttcctcatcgtactctccagactgaatcaactcgccaaagacatcatcctcggcatcctcctccacgtaagcctcgtcctccagagcctccaggacctcccgcagatcggggtccatcagcagctgtctgtgagcatcagggatgtcctgctggtcctggtaagtcagcttcttcttgacctcagaaggaagggcctcagcgggcagctgaactccattcttggcagcgtagtcagccttgagaatcaaatcggtgcccttgccccgccgtcctccaggtccagagtgctccttgttgttagtctttcgctccagatagacggagtcagacatgcccatgggtcgcagatgctgcatatagtcgtacttggaatcatcgtactcgataccgtagagagcggcctctccctcgttttctcgtcggccctgtttggcaaacttgtccagctcagcctccaggtcagctcgagtcagagctctgtgggggtcctgagagtcgtcgtggagctcgggaacgtctccggcctcgctagcctgactggcagcctcagaagcggctacagatcgagccacagcctctcgctcccttcgttgctggttgagattgtcgactttgacaaagactcgctcggaggcgtcttcatcatgataaagaggatcgtcttgcgctcggtacaccagcgaaaaggtctcggcgtcttttttcttaacccacgtttttcccattgtcgtgttcttttttcttcttgggtatatatgaagctggatattgtaattactgccttatgcacgatacgaaatttttatattttaggcttttgggtttactgtagtggcgagagatggggactgtgagttcgaatttcagaaggtgtcttgaatggaagcccgggggaaagatgatggatcaagcaactaaacagaccatatggcacaagcctatgattttttaatactctcaatgacaggtttaaccctgtctcaccctctcctctttttatatataaaagtattgttgtatagattttgtaatcccaactttttgtactttctcctgtataatcacttagagttgttaagaataatgttgaaatcagttgggagttagttgatgttaaaactcagtctctctgaccatcacaccgaaacaagtgatggttcaaagcaaccccgcctttgacaccccaaaagacttctcatcacttgtttatcattccacacaggcatggcgaaaataaatccgaatcccagagcaacaagacgcggtgtggccgactacgtgagacctggtactcggatcgctcgtccttctcaccacacgccaaccatagagcgaaatactagagataccaaccacactgagtcagacgcgacagtcccccaacaatgcattcgggtggaggttattgcagagaaaccctcgacgcgcccactgccgcgaacgttcgaaacgatgctggcgttctacgggatcctcttcatgtccacgttggcgtcagtagtgaccagggacacatacctgaaaattgcttcctacatgtgcagcctgaccagcaccgagatgaatacccgctactggttccgaacattcaccaggcgcaacaagcatctctttgacgatactatggaaaccctcaagaagttaccctcaatggtccagccagttgatatctatgggatggacagtacgtggttttcggatgacggacacgttgacctccacactgcacctgtgacgacaaagatggaatggctgaaaactttcctcaaagataccgataatggtggcgttttaagaatgcttgtggtgccataccatgaagggctggaggagtttgttgccgcgtgcctggtcaactatgtgctggtatctcacgagagtaccacatacgtcttaggggacgacacagatatccatgactcaatctctgttggggtgcctgaacccgaggtcattggagtcgatgctgtcgaccctaactcgcaaagactggactcacccgctccggcagaaggaagtgacaacgcagatgcctgtggctccaccgacacagatacccgagatgactccagcaacgataataagcagcacccaggagatatccccgagactgctgatactgaagatactattacggagcccccttctagccagctcgtgatagtgagccgaaagtctacagaggaggaagaaggggtcactgtttgcacggaattctccgataaggctctctcttacccctctggagatgttctgaagctgctggaacacacgctggaagagagaaccaagctgattatgaaagtcatcaccatggagaaggagctaagagctgctcggggcggctgaaagttacgttgctagagggagtctgtatgggtgtttatttatatatctttcaaaagcggttagttgctagtgtcactatatatgttcaagaagcgtcaagtcgtaaggtattatatggaggaaatgtaggcgtagaaaagtatatagaaacgaaaatcttgttagtttgatttactgatccgggtgggaaccttggtatcgtaattgtagttggggtcgatgttgtgctggtacgagaagttgccctggtattgtggcatgttgagcacgtctcttcggccaatgttgaaagcacacagaccaatgtagaagatataagccaaatggttctgcaggaagttgattcgtgaccacaggttgaaagttcctcggtggcacagggggttctctcctccctcgcacaccaccaccttgtccagcttggggtaaacgctctcctcgtctatgaacacctctccgatagagtgggtgtaattgagccagtcgggcactcccacgacgatatcgttccagtgagtcactcggtagaatcgtcgggcatcattgacaaccagaccagtatcgttgaaccacagctggttgatgtaggcggcgaactcagggtttccaagtcgaggctgtccaaagttgatcatgtaagggtcaaatcccagcagtttgaactgtgtagcaaacagctgggcctgagcagctcctagagagtggccaacaacaaacatcttgtagtcggtgttattgcccaggaacttttcaatctggggtccggcatgctcgatagtctcgttgaagcccttggcgaatccgtcatggatctggcagttctcgcacttgtccattttcttgggaaccaggctagggtcttcatgcacaacatcctgtcgctcttccaggttgctgagacccttgttttcggcagcgtagtgcttcaggatggcctgcttgtgttcaaagtcctccttggtagggatcagatgcgtgggcagagaggtcaaccaaggggcagtctgaaattgaatgtctgtgatgatatcagggatactgaaagttcctcgaaacacaatgtacttttccttcttcttgtggtcgtatgcaatgtagccggtagtggaggctgaggagaagttaccaccaaacactgagtccagctggaggtcggggaagtaccgacagctttctccgcaggtgaagtccgttctgagaggcgtgaagggggcattgatgcagtacgcgatgtttgagagtcgcgaaaacttggctgtgaagtcgtacagatcctgggtggcctggattcgagtggaggatgaagtggcatccacctgtccatagagcatggaagccaggtacgaaatcacctgcccgaaagtgaagttgaaccctgccattatttttggagatatgtcttatcaaacgggccccgacgatctatatataccagccaatatgctctgtagagtatacctactccgacacccctgcatgatagctattattcggaactggtggaggaggtgttagatgggctcttggaaagctgaaaattggagtatggcgttaccggcgcacgacgaatcgattggtgttatcaccatttcccctggagctccctatcactggcaactgtctgatgtcgtcaatatcacgtttgaagaacatctggatcgacgtatgatcggcagtccacataggtagtgcggcgagtccagagagtgtgcattaattgaaggtcgcatgcactgttccggttcccggtgcccttacttgtacaactgtgggaaatttggtggcaggagacccgttggtgatcatgtttgtcgcccagagtgtactacaaatagttgtaccctatgcaagacagcaacacgggaggaccgctatctacaagcagatccgtcctgtgattcaggacccaaaagaacgagtagacttcccgcaaattgaaccagagtacatagagacaggcttcgttctatttcccacgcatgtctgctgcaccccacagttccatgaaaatacaatgatgaacaattctccgaataatacatcgtcgacctcagaactggattccactaccttgatgaacctccatctcgagtaaattcgacactagcagttctctatagtttttattatcgttgctacaacactgtatgagacagattgtagactgggccaacttatagggcaaattctcttttcccacagcacccagttgcggatctcgtggatctgcaaatcattttgttttattgccgacttacactttttaggaaaaaagttgtaaacagagtgtcgttattatatacagcgacgacaaactacagtataagtacagtagtccatcgtttgcaagcaatatgtcccataatgctggccctttcaccaagtctcaatagattctggctcttcgtcggtaaaatcctgtggtccagttcctctaaaagcaggtaccaacccttggccatgctgtactccatgtgattatttcacaccaaaggttctagttcccatgttgtctgcagaagcgaaaacgccgatctgtcgatctttgacaggctacacacagcgaagtagcggaagtgagtgagactagggcaggctttagcctgaaagcgacgtattgtagatacactacaataactaaatccaatctcgtgaaaactgtgtcggatgaaatgtctgacacagatcaagagccttaagaaaatggacaaactcataacttggagagtacagcatggtactatagaaactcttggaccgcaagctgtgacagctatatagtttatgtaattaaatcagttgagtaatttaagttgttgaatcacatgctttcaggtccaagtctgtttggaaacggcccgttcagagaacatgtacccgacttcatcctttacagttcatgttgacatcatcgtgaactcgtggagtactgtactgtagtggtttacggcagtccatgtcaagctggaatgatgaacataccattgtgatctccagttccggccaagtacgaatacgaagtccaatactctctgtcgccaacaaccacacagctatctagaatcgtctgtattactcctaaccaaaaagatcgacataaggacattgtctaacattgtcgatcttcccagagtggtgccatgagcaaagatacagcgcaaggggaccatgcgtctgctgttccagatccattggcttcattttgacttctggggaatgacttctggggaggccgaaagtagttgcagcatccacggatgtcttagattcagcccataagcacgtctgacaagcgcagggaacttctcagcggtaccgaattgcttttttcagaggtgaggggaggaccagttgagtggaagaagagcatgtgagaacctattgggaagttgcaaagtcgaaagaaaccggaataggaaggtcgacaagggacgaaccagctgtgagtcatgagagatgaaagacgttagcagccttcacaacttatcaaacaagtatgtgctgtacgggtatgtaccgctacttgtaggatccaaaatacgaaaagctctatcaatagctgacgcacacgtttgaccccgtgtcgcattctccatggagaattgattttccaagatgcactccgtaagacgaacctcacaagatcatcaatcgaatagaattcatatccatctcaacctgccactatacatttttgtttaaccgcatggaactgttctcccacacatcttcagatcaattcctctacggcatataatcaacgatgcccgctcactatatacaactcattacacctggtctaagcccggatgtaactggatcgtttgatctctcggaccacgctgaccagcttctttttttcatcctgctccttctgtaactcctgtaagtgctcctcgcgcatggtgcgaatctggtctctgaacttgtgcaccaacatggtcaccgactcagattcggaacccccagaagcctccaacccagtcaccgctcgtgaagtaccagcctcttgcagtttgcttcgcaactggttaatctgatcttccatcttctgccgctctgactcataatccacagtctgaacagtcaggtcctcaagcgactgcacaacagagtccagttcccgactcagagaatcacacttgtctcggtactctgagacctgttctgtggcgagcgtcaactcagaattgagatcctgaatctgagcagaagatgcaaatttgtgtgatcgaagggcatcctgcagatcaagcaagtcacgcgaatctgacttgagcacaggtgtagacaccacatcacgtgtctgacccatctcatgagctccagtaggcttgatttcatgtccagcaccgacctcacgtgacttgctcacctcaccattaccaccacttcctcctccctcctgtagataagccaacatgtcgtggaaatgaggatactgccgctggtcaaaagcttggtcacgggactccagaactcggcctagcatgtctgtgttgtagtcaatctggtcgcgacactgctgggtcagttgctgacagagtccagaaagagcatgcaccttggcggggaggtcacgggactcagtctgctgcatcacgtgatcgtcacctagctggctgatcagcgtgtcgagctgcttgcccacctttactggatcctctgcctgggctgctgcggcggcggctgggttgagttgcgagtaagccagcacagctaccgaatgttgtaggactgtctccttgagagctgtgatgcggttgtgcagttcaatggcgtctgtgttcatttcggtgattttacgcacactgatgatgtgttcgtcagtggcctgttggctgtgtcgtttggttgatttgaggaaacttgatcgtttactgccatcttcatgcagacgtgcgagcgatttggcagcctccccgaccttcttttcgagctcaattttgtgcaggagagtctcgtatcgtgactcgagcagctgtagctccttcttcttttcgtccagctcatcgtaggacagaatgtggtagttctttgcgtcaacgatggctgcctggactaggaagttgaacgaaacgggatctttttcgatgtttatgaagggagacacggagatgtgcgtgtctgacgggttgggtggtggcaggaagtcgtttgcatcactgaaattatccggcgaatagttgtagttggacattgtgatggtggttagtaaaagtggtgaagatttagggttgcatgttggtgtttaggttgggtcacgatgcacggctgtgacgaaagcatatggccatagcatggcatgttcatgtatagtacagtatgtacagtactcggattgaaagtgagaatgtggccttttatatggcagagcctgtacttgtttgtctttatctgggctttatcaatgactttcagatacgtgttgaattaaggttaggatgttggccaggggaacaccgaaaatcacgaaatagtgtggtctttttattatggcctcttcttgtcgtgtactcaataaatatttgacgaaacagtattcactgctgtacagtagtattattgtactggtacgtacgagtacgcgtacagtacagtacagtacgtacagtacatactgcactatatatacttatactacttctcatagtccccagttcgaatcccaaactcgccctctgccatcccaatatggaactctaaaaccctgattatgcagcattttacttgtgtaccttttcctccccactcatctcaaagataccatgagtcgctggatatacacggcttcgggcgtgcttataggaatatccatttctggaattctctataccgcttttctgcgacctgaatcgcagaagaaacgatcgaaatctaacaagaataccccctcacagcccattgttgacccgccaaaggcccggataggactccagggactcattggaaataccccaatggtcctagtgccgtcgttgagtcacgcaactggctgcaagatatatgccaaagttgaggcgtgcaacccgggaggttcagccaaggacagagttgcgttgggaatcattcaggctgccgaaaaatcgggggccattgctcctcacgagggtcacgtgatttacgagggaacaagtggctctacaggaatttctctcgccatgctgtcgaaggctatgggctacaattcgcatatttgtcttccagacgacacttcaagtgagaaggtggatcttcttactaacctgggagccgttgttgacaaggtgcgacctgctggaatcgttgacaaaaaccattatgttaatagtgcacgtgacaaggctgttgagtgcgagaccggtgctgtgttctcagaccagttcgaaaacgacgccaactggagaattcattacaacaccacgggacctgagatcttcatccagaccgacggagaggtagatttgtttgtgactggctctggaaccggaggaaccatttctggtgtggccaagtacctcaaagaaaaactggacgacgtcagggtggtccttgcagactgccaggggtctgggttgtatcgaaagattaagtatggagttatgtacgactccgtggaaaaggagggcactcgtcgacgacaccaggtggacactcttgtggagggtatcggtatcaatcgaattactcacaacctgtcccagggtctggagttcattgatgatgccatccgggtcactgatgaggaagccgtcaagatggccaagtatctggttgacaacgacggtatgtttgtgggctcttccactgctgtcaatatggtggctgcttacaagtgtgccaagagcctgggacccaatcacaccattgtcactctatggtgtgatggaggccatcgccatttgagtaagttctggaagcaggccagagagcttggggagatcaagttggaggatttttagagagacggcgacatcatgatactttcatacagaagaggcatgtctagaaatgtataacattcacatggttcggtgagggcaatagttatggtcgtgaggatgtccatgataaagagtagatggatttactgctccgtatgatgttttagtgatgtaatgcaattatattactgtacttaacatactgtacagactttagttaagagctctgctgtattgtggtcagtctatcatactgtgccgtaccgtgtctatgtatgtatgtactgtacagtacagtatgtatacacattcagttcagaggtacggtaggggtaatatattcacataacagagtgaagaattcccagcaatgccttcatttatttcagcaaacactttacaagtttgttggcctcccatgaagaattgttccggcgcaaattgatcaatcaagagttgtcacaaattaggtcataattgagtacgtatatcgtgtgtcgggaactaaaaaatacgcataacttgtattctactcgtaacagtagactctgtttctgagatgccattagctagtctatctgatcggatgctacactacaaactaccaaaggtccatttgcgacatttattcaattacttgaagttctccatcaccctcaattggttgtcttctcctgacccttgttgaaaaagtcgttcatgcaatgccggtagtggtcgtcgaatagttccttgagaaagaagttcttacaccagggacattggaagtctgttaggggaggtgtttttgacatgactggttgtttaggggacagaaagggcttgaagctgggcgcctactccgtcttatgtacccgaccaagaatgacctgttacatcagcctcaagtgggccccatatttccaccgcgcattcatgtctcacaagagtagcccattcccacccacgatttcgaatcatcgtctcaagtcgcttttgaaggctatcacgtacgaacagtcacgataatgaacttcaatcatctccttgagtatgaatttcaaacacgagggacattccacgtaatctgaaggaggtgccgagttcgacattgtgaagattggttgtgaaggttgaggagagtgcagaggagaaactggagacagctgccgtatacgagtacttgtaccccacgagccccataataagtggtgtcaactgatttaattctttacccacctaggtaacctattgaagagatgatttatgtaatgtttttgaggcttgacatggtgttccttgtagagaagtaatgcttacccagaagtactgtatgtactatatgtactgtatgtactatagttactgtaggattccgtgaagaataatgtgtacagttcagtatgtacagtattatattatgtttataaacaagagccgtaatacccttgtatagcatcaaaaaaaactgtgtattgtcatagcgccaaaaactgtgtatttacttgattacctataggcaatcgaaaatcgactcatcaagatgagtctccaatcttccaggagcaactttcaacttgctcgtttatccgcatgggttgtagagccacttgtatcgtggacatacagtagtttgtatagttggaggagacaaggacatgataggcacagtagtagtttggtctgtagttttgaacaggtagtttgatctgtacttggaacagtttgttgagattagaatgaacatcaacaggacgtttattttttgttggcctctgtcaatacctttggttaatgtgactacaaccccaaaactgttctgttctttgctgtactgcgttacagtacttgcaggctgactggtcaacggactagtcaacgagggatgatgaggatttctgccataagtgtggctcaggtactctcaaatgccatgtcatttctgcgtctgaaaccgtcatgagctcttctaccagctctcctccgtgctatacattgtcagtaaagatcttcagcatccagatgtgcctgcgcccctctggaggtctgatacggcactccattccatattcgtttgtgatgaatctgagatcgatatgcacagtcaggaaatcaatttcttgtataaatttattcgagagtaatacaagcatttgtatgaccgagttcttgtccggctactgtgccaatatggttatgagccgccgcatggtacaatatgtacgatactcgctgaggctcaaaaatcaagaggcattccatcattcaaatactccttcccatacaagtacatactcgtacatgttctgcctttagaagctctgctattagccacaggatggtactgtagttattgtagctacgatattgtattgtattcgtacaaagtacgacgtactcgtatatactgtagcctgttaatcaatggttaagttacagtaaagtagccagtctctagcctgttgaaaacactcttctccttttcctcttgtcgacgcactttctgacatgtttccagaacagatccttggcgacaagtacagaacacactggacactttggaaattcaagagtggggaacgtgaagtacatcaaacacaatatggagctgttgaacatgaccttgagaggacattatatacccatagaattgcctccagccaatcgtatacgatgatttggggcaccaatgagttgaccaatcgagttacttgaacttgaagaatccgcttgtatcatacgatattagctgtatagtaaatacagcacgtatgataccacaattggttcagtactcctagagctacctattcgctaccaaacgtctcttccaggcaccatgaacctgtttcttatgtttcctgatagcaaattgatggtgtttttagcagtcgcagtgagtgtagtatgtactcttgacacagctgtatgaatgtatctttggacatactccattcttgagggacccaaacaacacactttccagaagtacaattctgaatggggtctttagagtctcattatcccatcatttcagcagaaaaagaagtctcgggtttaaagatacagcatcacgtagtatcatgcttgagaggcacgattgctgtatgtatcgtactagtacaagcccaatgtgtatgataactacagtgctgtctgcacccgctgcaaccgaatcaaaacaccctcccggtcacgtcacagtcttcttcacattcaaaaagggcgtccttctgggcacctcagtgtcttcgttcagtagttcaaatacctcggtccaatactccaaatgctcctcgtcgacatcgagtgactcgatctccgttctcacctcttctccccccataatgtccctgagatacccgctgtgatcaaacttcttcggcactctcttttcttgtctgtcccctccagactgagcacgcatccctccaatcctcaacagctcttcacttatgtgcttgcctggggcatcgtccaaactcccgcgtgatggctcagagagtcgacgtagatctgtgaacactgttctttggctcatgtatccctcctgaaactccactcttcttttggccgcccttctgtctggcggatatatcggcttaccagcttgatctggctgcttgtcaataaccacagacagcatgggaacaaaccggtgctgtaaggacgcgccctgggcaatcttatggactggctgagtcaccacgacaatcatacgagcatcagagatgcccatgtacttggaggggtcatattgcacaggtaagaacagaggaagtgagtccacaaacgatccagacaccaaactgaggtatggagcatttaaaaatttaatgaccaaactggtctcttccgtcaactcggtgtgatacttgtcttgaaactgcttcgccacctctggactaatagcacaaaggacgcgctttcgacggtcatcaacacagcaaatcagccaagaagaaccgggagagtcacgcggacggttgtaaaacttgctgattaacacgtttgtgtgttcaagctgaggaataggtgttggaaacggtttcttgcttcgtatcgtcgcgttgagggtaggtagaatggcattctcgagggtagttcccaagagatccatcttcacgtgatttcgtttatttgggtaggtgaaatcacgtaccaagatctcatgtgattgggtatgagaggtatcaaggttgagtacagtacctactgtacagtatttactcgtactaagtggtggtgatgttttcggctgtctgaaaatgggtggattgggaaagggtaagataaggtttgtgttatattttagagggtctgtttggggggtggttattctggaaccattatttgatctgctacgggtttgtctattacactaggattgggtgtattgtggccaagaaatcctcaggtcacttcctgctctgttctgtcattgtttatgtgctaatcatagttataatgtcaatacaacccatgttaagaaaaaatgccgcttcattgccataaggcaggctttttagatagtgagactctgtgcctcaattcagcgggatctgaacatggtagtgtatttatccagatgcctgaactccgtaggagtacccgacagaaacaaattggtttgcaaacgtgcctgttgatggttcccaacgatttgaagatttttgaagttctcttcacctacagcttacccttgactaattggacaattggttaacagttctcttatcaggacttccgcaagacaggagacttgaggttgaacagccacgaagagctcttgttgcgtctaatagggtactcctcaaacggatcagtggctggagaaggaatgtggttgcgcatgaacaaggccggcttgggaatggtgatttgaggaggaagaactcgcgggacgttgatgtcacgtgaagtgtcaaccatatcgaatttcaactcacgtgacggctcaaagttggttgttcggtcacgagatttgatcaaaacgtagaccaaagcaatcagacacatgaacagccaaatgcctagacaagctagagcaatgtacagctcggtgaacagcaacttctccaccgtctttatgattctcgcaattccgtcgctgacgtaatctgccttctctgaagcctcctgctctatgtcttgatggctcatgagttccttgtcgattcgaggcaatgtcacgtgagcattatcgctgacccagcccattccatcggcaaccttttgtagtttcagtgtaactaggcattttgtgacgccctgaacggccccatggagcggagtgtctttgaacactgagtcaatgccattgttcatagtatcaatgaaggtggacagagtagtgttgactgtggatgtggagtctacgacccaaccaagcaagttcttgtttatgtgagtctcttgggagttgagaaacaggtttgtgtcgttcttccaagtctcaatttcccgcacaactgtctcagtaacgtcagcacctacctctgaagtgggcacagtgaggctttgtagaccactcttaaggatagacaaaagaccgagctgtaggagaaacgctagaataccaaataatccaaccagaagaagagtcagcatgtagggatacaaaatgtatgcccagtaccactgactgaggttgcgttggtacagtttctttccccaggcgagtttctgtttgaccatggtgacgtacttgtgctgggcctggaatagaacagtgtggaaagcgtgtctcttctcctgtttcacgtccacagtgctttgttcaacccacaactcctcgtggtacctccacagtctccattcagaccatgccacaggcactatcatgattagtgctagaatcaaaagtagggaaataattaccttgaggccggtgttcaaaccagagttgagctttgcatacacttcagggatgtttgcgtctttgcagaattgagctgacttgagagcaggcaccttgagcgagtcagacacattcaatggcgttgcaagagtctcgttcatgctctttgaaatggtctggaatggttttcggataagagactcgatttcgttcttgactgtctcgaaatcaggcaccttgtccttcacagagtcgagtttttcgttgacagacgcaggaattgagacattcttgagcccatcgagctggagcttgacgaaatcaatctgaccagtgtactcctcggcttgcttgcccgtgatgagatttcccaggtccacaaaggcgttggtggcggtgttgagaccgtcagcaaggccattgagacccttttcaatctcaggaacaactgtgctgatggtgtcattgacaaatgagattacgtgcttcgaggtgtcgacagccagagaaacagcaccttgaaccacaagtgtgataagacaggtgtaggtggaaatgagcatattgacggcgaatatcaacagctcctgaactccagtaatgatcaaaagaaccatcttaatcaaaccggagacaaacttctggatagccgtggcaatcacgtgattcatccccgtggccgtgtagtgaggaatggacatcattttgctgactgagcgttcaagggccgaacaagaccgttcggagttggattcggcgccgtcaagttgtccggacaacgacatcttgaacatccacagcttgatgctcaccagcagcagaccgatagtccatttgttgagccaggtctgactgagacgggccttgagaagtggtatggacgagtgctccgtgggactgttttgcgtgttccaccagagttttatttgtgaagcgagcgacattgccatagtgtgtttgagggtaaatacagagtggttccgtggggtcgtagtgttatatatgactgcctcatggatggtcgtggggctgtttcatgttggaaagaaaagggtatcaggtaaaactgagaagtgcttggatcaagaagcgaaaactcggagtattgggtatttcgacgcttttaaaatcatctgagatacttttggagcgatctgagcattttgtaggcccctagagaacactgatgtagacagtgatatctgcctcatcgtttaagttgcgtcatgtgaagtgtgaagctgaggctgtatacgaaaaacgaggtccaacaacacagcagcaataccgtgggctgagaaatcacgtgatccttcttgataacatcccccccccccaagttgtcttatgaaagcatccaagcgagcgacagtcgaaatatgaacatttcttctgagttgttttttttttcttctgtcagtgtcttggttgctttaacaaccctcaagtactttattcacccttctagttgatcttgagcttattttcacacactgagaaacatatttcagtcgatctagccctatgaaaaagcgtcaagtcattcctgggtgcttcgactccagcagtatcaatctgtgattcgggttactacagttaattagagcgagcaaaaaccggtcaaactgatgccaggaatacgaacccagcagcgtatatatctacggatactcatacggtgactaactgtcttgtacgtacagtactgtactatatatatgaccttccacctctcactctcattctcccagtgaacgttggggttagggttgcatatttggaacataaaagcctgtcttctattagtggagaacaagaggggtctacagaagggtcagcaatagttcaatcgcataagtttggactttcagtgcgacaataatgttctaaacactgagcctgtaacttcatcgcggtgtttgcatacaaaaacaccgagtatagacctcctccattttcaccactccacctcaaataaagtttgatttttcgctcccaaatttcactctgattcaaggctgagattccactctacaaccacacaagtctccactttctttacaacatgagcagcagagtgtctggagttttgcccaagccgcgatccatcgtggttccgtacgcgtctcggcgaggctttcctgtgggccagggctatgctgacgagaagatggtgccccggggctctcatcgattccccaagaagaagaccgttcccactgaagagcagctgattgccactcgaaacccccctcgaacctccgccaagcatgccactccccggtccgagatccacaagtggcatttgaagatggcagatctgcgtaagcagtatttggctgactcgctggtgtctgctgagcgagctgacaaggccaagtaccactaccacaagcggtaccttgctgccgccgagaaggtcaaggaggatgctcgaaacgccggtctgaccgaggccgagcttctgactctgcccacaatttccggtcttcttaccaactcgcagctcaagcgacagactgaggacgagtatgaacagaagcgtctggagcggcagtacaacgaccagctgcaacagctcaaggatgaggaggagcgagctcgagtgaccgtccagctgattgaccaggccgacgacttcattgtgaccgaggagcagctgattgctggcgtggagaaggcctttgtcaacggctcttcttccggcagaaaccctgtgggcggctggtccatcacctccttcaaggaggactccatcatgggcgtgggccgaaactcggccggcctcgagaaactggtttctctggccagcgagtccgaggagtccaagctgaccgagattggagacgccattgctctggagcttaccggcgtcaccaacaacggcaagcccggtctgggccgaatcgccgagatcctccgaggagacaatgtgctggagcgagccgagaagctgcgacttgatcagaccaaggccggcaaggcccagatcaagaaggacatgggagaggccgaggatctggccgagatccgacaggctctcaaggatatggaataatgtatatagcaaccgagcccggcatgagaatgagtgactgggcaaaacaactgtctgagagaagtatctcgcagagcaaagtgaataaaattactgatatgacaaacgctagtgtgggtggtgttctggatgtcttggtgacgcagaacacagtgggtttgagaacattcttactacactgtgactatggacatgttgatcatacacgactgccagaggtgagtctgttgactctgaacagaatagagactctttccacatggcaacgaagatttcatctacatctgtcgacggtaatattaatacagcagtatggacagaccatgaataacacttacattactatgcatatcagtgtccattcagtgatattccggtactgtactgtatagtgtcatctaggcaaactggtagactacgatcactctcatattgtagtaataaatcaatccattaacatgtcctgcatgtgaagatgaattccactcgactctggttaagcaataacacaagaggagggttggaaagttcggtagcctccaacgatggtcacgttggagttgactcggtaggagtcggtgccgtagtctcgagggatagccttgctcattgtagtagtgtggtagttgtagttgtagtatctgtttgatggagctcaacagcgggtcccggtgggccatatatactggatttgggagattagtaatgacctggatgtgatatcaatccaggtcaatcaataagcaaatctttcaaggcacattcaataatggtccatcgcatctcattgtcacttctcgtttcggtgggttgatatctgcatgcatgcaggggctttattgacctgtcctaaagaggaaagacgaaagaggacaattcaatgggttttcatttcaaagatcgatcttgaacctttacgtgtgcgctattgagcactctgaatgtccttttcggttctggtttgtcctcgtcatctcattgttgaagcgatttgatatgcacaccctgttcaggatgcgcatacgaataatattcagtttttcgattccgatatccaaacgggatcacttgttaaaaaagataatatcagcctggaattaacgaaagaagaagggaacaattgtccttaatcaccagttcatggtggatggttgtcctgctctgttccggtacctgttcctgttcttgtacccttataaacataactgccccttctactaagcctcctacggccactacatttccatacctctattcattaactaaatatcatgttatcctcttgagggcgaaatatccaaatgcagggttatattgcactagcatcccgtctcaaggtctcgtctcaaagccgccgtaacagcaaccgttggctagcccaccgtctactctgcttatttaagcgactgggcaacaaagacctgtgtggccttcaacgcctcgaatcgcacctccgagttatcactgctcatgagctccataatcttcaattttgccccgtcgtcctgcagcacctggatagcatcaggcagcaacttgcacacgttagcaacgtcagagcaggccacagcctgaacagtgggatcagtggcgctcttgacaattcccgccagcatcttcagcaccttccagtcgtcgtctttgaactgaccaacgttttcctgccagaaaaactcggatttgtgagcaggagtccaggacaacttgccgctcttgatttcggcgtaataccggtcgaaagtggtcattcgagcgacctcttcgttgagctgtgtgtagaccacctcaatgtcttcaataagctcttcatcggtccattttcggtcgctaaagtttttgaacactgcctggccctggttcagcagcagcgaggcaaccgtgtccttgggggcggccttaagcacgttgacgatgatagcgacacaaagccgcgtgattttctccttgacggaggttcgtgcagcctgcagaagagtggggatgagttcggagaaagaggacaccagctggtgggcagccttgttgtcgaagctctccagccagatgaccagcagggtgtagtactgcagatgcagaccacccttgtcggccttgatgatgtccagcagtttggggaccagctcggagttgaacttccagaacagaggtcggtaggatctgttggacagcagtacggccagagacacggtgcccacgtcctggacctgcacagatgcagatgagccgatcagaagacccacaaactgcaggtactgggctgcgtacttttctgtggtgagatcgaccgtcttggagtcggccaaaagcacgacgatggacttgacagccagcagttgaatctgctcgtcctcagactcgagcagcttgagaaggggaccaaaaggcgaatccgagtccagtttactcagttccaacatggcctgtgcgaactcagggagctcctggaccaggctagcaacaaacgacagaatgtacttggccacatcttcccggggaatctttcgcagcagcgacacaaatgaggtcgcatagtgggttaggtccttcttgacggtctcctttcgggcctccgggctctgcttctcaatagtcttgatcagagcagcctcgtcgggggtcagcaggttggcccgcacatagccgtcccaaggaatgggtctggaccgaatggcggtctggatttcgtcgagatagctgctgttgaatgcaattgactgggttagtgggggaaagacgccatagctggacctggacactcaccataatgtgctgttatgtcgtttgaggatgtcgacgacactatgatgttgataggtgcagtgcatggtaggagtaagattagggttactgagggaagtaagcggttgtgggttcgactttgggtggggacaaatatggggaagactgtagaattggttaactggcaatggaggcaatataattcactgtaattgggcatttaaactgcttttaatttacttttgattcagtgctgtgtcttttacagggcaataatagtggtgatctcttgataggggggcgggctacgtaagttacgacggatatcaagggagtctctattttgggcagatcctctccgattctgcttttgagaaatagaatagtatgtagatagacgagtattgcacaagtacggtactcgtctcttgtttcagcaatgtctgtggaggtcttgctcgacagactcctacatataaccagttgagtctacacacacctgcttactaacattgagagcacgttgtgggagtggttcaggaaaggtgctcaaaatgagccataattgagcaagaacgtttctgatggttcacgtaatagaatgagtatgtttttctctctactatggccggttttccacctacaatttcacactcttcgatccacccaacttcggtcgttccaccacgcataaaattaacttcacacacgtcacgatatgcatgtcgaggctctccatctcgacaagttgcaacactacaacctcaacacaaaccgcacacaatggcaccgaaaaagagcgtaaagaagaacgtggatgccaccctggagaagaaggatgcgcccccggtcgctgttcctgttcacgtgaccaaatccgccgacaacgataacacaaacgtctttaccaaggtgctcaacaactacaccaagcagagcacccccaagctcaagctgattgactcgtttctagcctttctggtggttctcggggtctttcagtttgtcttctgtttgctcgtcggaaatttcgtgagtaatatgcgtgactaggatctcaagggcgagaagatccatgtggtagaaggacacttaccagtaacaaatgtgtgctggggacacgttagtgaagtattggggagaatccgaagttatgtttgaaacagcaggtgtataggggaggactccgggtggaagtttttgttgcctcttcctaaactacatcttatggatgtgaacagatctgattgatcactgatgacatcggcatagcggtttgcgaagctgatacataatatcgtgtttgacacgttctacgacttgacctcttgcatccatggtcttctccactgtcgactcttctgacagtaccatcactctagcataccagatcattttcgtgggagatctatgggattctttagacactgagaagagtcttgcaccatcaatccctacattacattctcctccatccaactattactgctgcccatttgacgccttcacttactgaataccgtactaacacagcccttcaatgcctttcttggtggctttgccagcactgtgggccagtttgtactcactgccgctctgcgaatccagaccgcaaaacagaacgccaaggagtttcctggcgtcagcagcgagcgatcattcgccgactttctgctcggctctctggtgctgcatttctgtgtctaccacttcatcaactaggccaaaaatgggatatattatagaatagactggacggaatggaatcgaacccttatgaaaacgaacgagtgagtcttatatggagagttgtggcgtatgaatactgtagctatggcatcacacgccacgtcggtaccatacacaactgtagaaaggtgtgtaaacagatagatacaatattgagatagggaagatatcacacatgccacgcggtgctaccacattggccaaatacatgatgaaatacacagcgagggcaactaattcgaggcattgttgcggtgtggatcgttgcggagaccaagacgtttctagagtcatgtcaaaaagacaaagacgtagatgcgaattaccaagatgtaattcaacatttgaagcgagtgggatactttcctgtaagcaattaagacgctaggaggtgttgttgaagaagcagaaggtactccatggtggaaccagccatgccctagccacgctgagggtaccctctctcaaacagaaacgggtaagaagcaggtatatctcttttatgtttaaaacgtggtgtacaagtacagtacagtactagaatatgtaccagtttgtagacttttgttgatggcttctgtgtcgcttttggccatgggacaagtgatgaatcagaactcactgccgacaacagccgacatgccaaccgtcttcgttttatggctttgcaggatttgctgtggctcattgctgcaccatatttggcctgtttctctatcgacaatcaagtatcgacccccctgaatgggtggatacatctgttgatgatcaataggagaaccattggtatcaggtttgtgatccatgtggtctgggcggtcgtgtgaacgagtaatatcaacgagaccacgtggctgcacagggcgcgggtgatactggtatctgcaactgggaatctgtcgagctgggctccctttcgagaactggtgtctctcctgactgggatatcgaggaggaggatcttcgtagagatatctcaaggggtgcccgatggggtatgggttcattggtttctccgtaggagaagatccagggtcatcagatctgttcatttggtgctgctgggacggaaggagttgtagaagacaggctgggcatgggctttcgccagttaaaatattaacacaggggctttgttgcaagtcccaacaacgttaaagagggcctaatttgtttgaaccccaagtaatacttgtcccaatcccgtagtaaaatctagatatactcaactaaacccactcaaatactacaacatcaggttgacacacttgaaaggtaaacaaaatgagtacctgccaaaaaaaagccatgagagagatacacacacacacaggcaaaaacaatggcgggcgcctgggtatccaaaaaagacgaccgcggagagggtcgaactctcgatcttacgatttcagaacccgaatgtttctaacagtcgtacgccttaaccaacttggccacgcagtctcagatgtttgctagggcagcctttgttagttttgagaatgaaaatgtgattttgaaaatttttccagcaatgaaattacttattcgaccttatcagaccgccttaagtacttgtggagccagatttttcagtcctttggcattgttttgggagctctatcgccaatcgcaagaggaaacctctggcatctggatacacccttctttgaatagtatgaacactgtatgactgacaactacagttcaaaaatgagtagttctgaggattacaagaactttgacaaaccactggttggatgtagtaggcttacttacctgctcttgttcaaccgactctacggtggtgactgcactttcctccatgtaaaaaaatggaaaaaaatagtaaaaaaaacgcctagaagacaccatggaaatctttagggagcttggaaaaataaagtggagacaatgttaacaaatgggcgttctctatcatcctttcgatgccattgatgcatcactcgtgacttttcacaatggcaatacctccaagaagagtcgaggatcttggaagtatctcagggttgaaattgttggttagaaagtgaaatatatatcttccactatcaaaagattacaatactggttgttatgctagcagttgtgtgttaatccttagaggtatgttaggtccgatatatgtgtattgatacgtgaaagcaacgagagtgtagacacttcaagttcattacttacgcacccagaagggactttgtggtcaaaataatcggcatgaaagcgtttccttcccgcttttatactcattcacaagcccaaacgacacccaggatccgcaatagtttagtggctagaatttccgcctgtcagaacatcagttcagctcgcgggggaccggagttcaattctccgttgcggaggattctttttggaatccataccccatcatcttcctgtgctggttctggccgttttgatacacatgtcggtggtatgatttggataaccagattatgagtacagtatgtggaatgttgagtagaaagaaaatatcacaagtggagacatcatagggaaccagaccgtctaacctacactacggtatgacacgacacagtaggcgccgtatacctattgcgaaacgctgtccggtggagtacgacttcttccatacaaacgagatgttagaagctttcatgacaacggtgggaattgacgatcttgtagcattcataagactacaaatacgcagactgtcgaaatattcagtctcaattgtatcaatttgacaaactggagcgtatcagagagtgcaaagtcagcggatctgtaacttgattcagttttttatcaagtaaattggagatgtctgacaacattccaagttcgtcagttataattatgaatattctgaatacgtctaatcctcaattcagtacgtgatcaacgaggttcaacagtacgagtactgtacatattgttgactgtacttgtgcgaaactaagcacaactatgggtacagtactgtacgtggactcgtgagaagagccagtgctagttcttgttgcaatagaatatatagtggcatcttcagttgttcgatcacggttgaggtatactgcacattatatgagcaggctacggagattatggcgagcactggccaacatgctcacacttctgacactctcgtggaagaccataccttcagatgcccagaagacacacaagagcaataagtacctgcttcaatggtaagttgacctacaagtgtatcttcaacatcttttattgaaagtgtgggcaacttctgctaagaacatatctcacacaactctccgttcatagaacgtgtacatccgtccagagttcctattttttgtacttctgacttcggagacactaaacatctctcgaaactacgaccggcaaaagcttttcaccgacctccgttctcgttttttgtcgtcgaggaacgatgtcttgggttacgagaaggttgggtggagtattgcagtacaggccttggcgagcgatgagcacaagaatactgtacttggcacagagttttcatatttatcaatctatgtgaaagggaggctctatttctgcctgtacaacgtactctgtggtagtagagctagattgaacaggagtatatcgcgtgagagtactgtacagtaccggaacttgtacatcccggtcctcttctcacttactgctctccaacaagtcccccaagactttctgaacgagcctcccgactctcagtactcattacaagtactcatcgcagtaataccccattgcatccacgagaccgcctcggccggaacactctaccagtatactgaaatcaatcctcactatacagcacatcgaagtcaactccatcattctacatggtgtgtgtcgacgacgatgatctacccgaaaaatgtcgcagccgttttgaaaaaaagcaattcttccctaacacaagacaccctgattatagggacaaaagaagagacatgagaaaacaaacaattctgacgtaagaccagaccccaaatgatcacaacatcagttttctctttatgctaagtcagttctaatggtatggggatgtttggaaggatttgtcatttgagtttcggttgagattatttacgacagcaggatgttatcgtgaaatgagaagtaatagtgcaatccgtacatggacttcatagatatgctgcccaccctttggagatggcaatggtacaaaaatcatctctctcatgtccctatatctcattttatactgcgcctcagcaacatgtttttatgcaccagctaggtttgtcgatcaggagcaagagttgatctaagaagatcccaagccgatccaagctgctgatccacgtcgatctcaagatgtggttggtagatcagatttgaagatctccggtatgacgaaggtcacgagccttgaactagtctgaaagtgaacgtgagtgtgagtaaagataggatagtgatacagcacgtgtcactggcctcatatgacatagacggaggctcttctacatgcttgctcttcgtattcactcgcgtaaggctcctcaaacctagtctctgttgatggatgctcgaggcttagctggactgattgaaaaaagtggattttggagccatttggatagaaattggcggaaatcgaagatattactaacatagaacgatgctggacatcttaaagaggaatcgtaacccccgaacaccctccatcgctgattccaacaactgcatttacaccttgctccagacatctatggctgctgcttggctgcttaagctagagctagatgtcgattaactccccagtagcgattggcaggttctagttgacgacagaaaaacgcggaagtcgagggagggttccagaagcgagcttgcaaaagatttaaacaataacaaaggaccattggtggcttctggacgtcaggggtgtcattttgacatgtgttctgagcttctggaacgctagaaaaagaaccaccgaatcagtgccctctctatcatcattggtgtgacagatgggttttgtacacagatttatgattctcggtgaataagaggagatatcgttggtacgcgcagggaaattggggaaattggggaattcgtcgaaagagatacacgtacatactatagacgggagaacaagtagcacagctgaaagaagcattttgacagatccaagacagccgagttgagacgaaaatattagaaatcgcaagagctcttatactgaatgctcactttgttaaatgattcaagtgatgcgcctcatcatacagtctacatgagacaaatgtaccgctgcttagacgtggaaatgagtcttcaacacatcgagacaagagccagccgatgaccgtggtacgtcacgtgacaggaattgtgaagcatgactgtcacgtgaggggaaactgcgttgatatctatcatcttaagaatctataagagaagtacttgggtttctgttccttggttcctagataccctggtcgaaactaaaaaggttaacctgtggtgattatggatgttggttgattcattctggaggataggcttagttgatgagatgttcatgaagataagtagattagcaggatctagtggatcatattggtgtaacttttgtttcatttgggtgtctgtggctgatttcagctgctgggacaacaatgacttgtaagtttttggggtatctttttggaagaaataagccgaatatagttcgacttcagttgggacattggttaaagggtattatttatgacgtaaaacagttaggattagttgagatggttaagtaaatgtccatctcgatatatggaagcgctttaggtcaaacacttctctgaaatgtttctgaaataattcatgtcaactccagacatcttgactgttgctcacccccttcccgagtcccttacttctgttccgcattgcaggctgctccattgcctgagagacgcatcgacaagggtgtggagctaatgtcgtgttgactattgtttcgcggacttgttggagtcgtatctaggagatagaatggagcgtgtcggtgttaatagcgctattacatgtggttctttgatgtctgtgaaggatgcggtatacgagtacattctgtgagggttattctgaacggttgaataacataaacatgtttcagagacgtggcgatctctggggagacttgttcgagtgagctgcgaagcgatcagggaagacgatcagttcaacttgcagacaaagagatagtttctgttcgtagttggtacgaaataccaaaaatgtgaactagaaggagcgttagtgatacgtactcgtgctcactcatacggacgttgttaccgagagaccagttacagacaagtccgcgaatcagggcttcctgttcgcacgagaagccatctcacaatagaaagtatgggtgtttcaaccgcctcgtttgagtgggacagggaggttcaatgctgcttgtagtgagcagaatgagagatacgcgtagttgtacatccatataatagtagtagcgggggtctggtgacttgatagtagctataaaaaggccacaaacaatctattatacttgaaaacagtctcgaattccccatgcaacataaacatgttgaagggtaaggtcacactgtgtcaccaacaggtatagttataggggtgggttgtagggaagttaaagagtggggtaaagaagtggaagagataaggagatatatgagaagatgtatggtcatgtgatcaagtcactgtacggttcgattgcggcttacttagtcgaaagttgcatggtgggtgatcgagacgatcaagatactcttttggcctgtctctttcggagtttgagacaagaaccacatctccagaatctccacatcaacggctttcaatcggtagatcgtactaatcacttctcacttttcaacttcttcacttttcaacaacaaatccaaaggttcccctagtcttcactctgcttaaacaaagcagcagactcgtaccgttgtcgtaagtggcaatatatcaaaccactagtgatcatatactatcgcataattcattacacctaactttcaataacttaatgggtccccgacccagttcgggattaccaacccagcatcctcttcgtttttccctccgagcacatagctctccgaatactttcatggttgcttgccgtggtttaacaaataacacagcacgccttcttttctttcttttctccgtcatccccctcttcgagcttctctcgcacacttcggcccttaacactgcccatactgctacccatgctcatgtgcatggtcgagctgctgctgccctgtcggtgtcgctcaatctggtgccgtcgaatctcccgcacaagatcgcaaaagggctcgtcgacattgactctgtaccgcgccgaagtctcgaagaaaggcacgttccactctcgagccagacgctgaccctcgactgtagaaacctgtctgtcagcagaaagatcacacttgttgctgaccagaaccacaggtgcacgcgccacgtccttgactcgcaggatctggttgtaaaacagctgggcctcttcgaatgagtcccgtgaagtgattgagtaaaccagcaggaagccatcgccgttgcgcatgtactgttctctcatggcggagtactcctcttgtccagctgtgtccaggacatcgagggttgtgaggttggtgtcgatgatgatttcttttcggtacgagtctgggttagtacgaactgaatgagatatggaacgaggcccactgaacaccgaggagagaagtactaagggatgtcatgtgatattggtctgatgcgtggctgagtgtgattgagtgagttctaatatctcatgaagtattacaagattgattctggtgctggataattgatcgtgtctcggtcgcattaggtcgatagaaatcagaacaagagtacgttgtaatgatagacagaacaagagcaaaggagttgtcgttgtagtacttggagtccaagccgggggatatatctggtgaatggcatatttttgggcgagtttggttgttggagaaaggttgtaccacaggtcgcaatgtacttgtagtgaccttgttggatcgacacaatttcagtcgttgccacatccatattgatcgatcaacatttcacgagatcacttggtgtttcaacggtctgctagcatcaaaggtctaacaggtctatcagctaggaccagaaagaaggatagttcgcggtagcgtagatactgaagaatcaatcaggttctcttggactgactaatcacgtcagatctcacaatctaacacgcgcacaccacatcacatgcacagacctgtccccgtagttgcatccgatagacaatttgacagaactgataaccccaaagtcgagttattcaaacaacaagtcccttatcgagtcacccaaacaacaatgccctcatctcaaaaacctccccatgtatcaccaaacggttcgttctggttcattcctgtcctttggccagttaccacatctacctgccgtactgtactgtactcaccctcaatagttggatcgtattcgtcaacgaaatggctctgaacaaactggagagtgattgcgctctttccgacgcctccgccgccaaccaccaccactttgtattctcgctgtgaaatgttcatcttgtcgttagtgtcgtctttgaaatttcattctaggtggttatttgcatgtatttgtgtaattgaagtggagccaataaggttaagatattgagtttaccaagcagaatctgcacaaaccactttgtgttttttcggttagccaggacaaggagagcttatttagactcattcacttttttaagcttcggaataggggtaaattgggtggaggtggagaaaccggtttgtgggtgaagggcgagcaaaaagccgtgctggtcacgtgcagagtaaacagaccatgtggtcggctcgtaatatcgcgaaatccgcgactctttagacgcgttcggcggcattgggcgcaaagcgccgccccttggtgtgccgtatatttttccacagaccagatagcgtctttggaacaagtctgatcgactcgcaacggctgggagaacgccgcgggtcttttgttttttcagaaagaggtccaaaaggaccagttggaccgaatcagaaagttgtgccggtagggtcccagtttggaggttaattggggagatgacatgtaggtcacgtggtttgcatggatcgggacgtctcagatcaattacgggagtatccagagctgcacgtgtcctgtatagggtcttcacggatgtgtcaagtaagcatctgcaaaaattttagagaaaggttatttcagaatacgatgtttacttgagtttacttggactgtaaactagtcgatgggggaggaccgcatctccatgattggcaggaaaaggtgctcagaacatggaatatgatccctgcagttttttgatcgtacacgctggaggaaaggcaatgtagagaatcagttgaggggaaacctgggggaatacggccgccataataacaacttcttttgtgcggtgagattgtattggggtctgcattggtccactttggggagatgagctgtgtggggtagataagagctgtaattggtggctggaatgatgaggtggttatgacgtgtatttcggggaattgtcgtgttaatcaaatcaaaatggtgccatattggtgttttgttcgcctacagtacaagtactgtcttcatcttgctatatcgtacgagtcagatattactgacaaacgtacttgtacttgttactacaaatattcgataaatagcagatcataacctaagaaatgtcgttaattaagaggatacataacccacaaccacacgtgtaaccaccttcatcaattacaccacagacgtaggcacccctacgtgcagtatagtacagtacctcggctatctgactcgctccaagagagacagactttggacttgacaagacagagattcaggtggtagacagttgatggctagtcaaaggaacggggaaaaattcatttaaaaagccgttgaattggcagactatttatggggtccatttctcagatacatttccccaacacttgcaaccaactctatacatcgttgactgtattgttagaaacggataatcctttagttggtgggagggacaaccaaaggggagggggacaggcagtgagaaattacccaggtctgttggagaatttcgagtacaagagcttgtattatattgttgtaagaaaaaaattggaaacatgatacaagaacctgtacaagtaagtctgctccatctctttgggtttcatatgtctgctacatcaagaccacagggccaggggtgcctcgacagttacatccataccaaggcatgaagaggtccagagaatgctacaagtagccgagatttgagaatacataaaccggcttgaacttacacctacatgacttcaaacaactccctgcatctctttcacctctcttacgtcatctcatacatctccagagcactctcacattcctcgcgaatggcctgattttgttataccatctctgaggcttgatcggtccagatctaacacgatcagattgagaaactgctggaaacggacaacattccccgctaattccattatatatcaacttcattatcaggtaggtgctgacaggtgataatacggcctttaacacaccagagttgcaagttggacagagcaccccacaagtacatactgtaccgtatgtactgtagacacagatgtgatgttacaatcagagacatggccagatcgagaaacagactacccacttagaccgtccgcagctcgagtagtacatatcgtccttccccatacggacacttttcacaaccctataaggggaaccatttattttgcaggaaaagtaaacccgtccagaattggccaaaatttacccacaaaaaagaaactacttatgacaagttgttacaagtacagacttccagccacgttgaaatccattgtgtacttttgactgtcattccccactacgggtcacaccacattacgaagctcaaactgacattttcgctcgctgtcagacgtcaatctagtccaggtttggtcaggccgcgaggtgaaactcgctcaaatacgcgcaatatttgtggggacagttattagctgccgacgctataatatggcgtttttgcatccgatagtgtcccttatggctagatatatcgagtgtagtgttgtccattctgttattattatagttagttaagattggcattttcttatcaaaacaaagacacaatggggggagctaattgaagacagttaagaccataagtaaagcattaattagaaatcaaggaagtgggattctcactaccacccttcaaaacaggtcaattgtcacggtgagaagagctttcagttatcccctcctatgttactatccaacatgtactgacctttcagtatagtatacatctatcaagctaaaagttgcactaaaatgccatacaaacaggctcccccctgacccccttgaatattgatgcgggcctattcttggcaaaaacaagtcccgcaaaactagtcacgtgaaacattgagatgtttgtgagtgaaaagagcgtatttaccgtgtcagcgacttgtcatctttggagccatcagaacaatgggtcctgtcgcttataaaagtggttagtgtgtctgtaggtacagtacagtgattgcttcatatctgcataccaccacattgaagccgttccagctgtcttaagtaggtttctgaacttacagattctcggagctaagcggggttaaagagaaggagtcccatcgtttctgaaagtgcttacaggatctgatagagaatttggatacaaaatatgtcgagtacataacataacccagctgtcattaacctgctgcttgagtgatgtttcttcttcccagcttatataatggctcctttaccatcattctgcagagggcatacagacagggagtacgagctgtcttctaaacaccaattgtagatacacggacttattgccaggcttagggagaagccggcgatgttattgttgtggcattattgattggtatgccgaaaagtggcacgactaatcgaccacagagggaaatacagaacgagtgcactgtaggactgtacttgtatcccctgtgtttataagcacggcaaattctctctcactatcagtatgaacagaagtcgccgtatacgatcagatggttccagagttattatacttatagttgatgttcaagaactacttggtaatctttaaccaccagtttgaggtctatgttcattgttctgtactagatacagcaagtagaagtcatcttatccatgtgtatactaacatgtgaatttgtttcaagtatctagactgacagattcgttatctcctgatacttctaatatatctcgaccatggagacactgttcatcattcgtagctcacgtaaatggataccagaacaccgcaaccactccaaatcatccgcaagcatttaatactccgtgtaattaccctttcaacgagtttcacctctcgttcatctccgttactccgtcgtttccgttaattggtaatacggtttggaaaacggtgatcctgccttaacaagtgtgtttcgccgggcagtgcacatgaccacttgagggctggataagggcattacggaaattcaattgcagactaaagcgcatggccggacgaaataaaatgtcggagtggaatagttgcggtgtttccgggtggaggacgtgcgtcaagatgagtttagctgtaaggtagggtcgtgttgatgcaccggagaaataccaggtaaagaagttctacattgcgaatgataattgcatcatttgaatcagctagcccttttggtcacgaagataccgtttttttttgtttctgtaacttccacaaacaccgcggccctcgttcccagaacacgacaaagttcaacggcggcggaaaatgttcctgatcggcgttaaagatccggctggagtggtggaagaggatgtggcattcgcttcttgcctcttgtttgatcaatctgaccattgactgtagtatgttagtaccccgtttaactcccactatcatcacgcgatggattgctctcttgtttgatcgtcggtctgttacgggttatggccgatcgttcaacggcggagtaagcatgttggatgttggctttgggtaggattttattttctttttccgaatgaataatcgcgtcgggttagccgcgtatgttccagcacgtgtaaattgatccttgcactggtgtttgtttatccgtccatggaagggttactacttgtagccattttccactccgagctatggatacggctaatgaacggcgttgtgagatgaaaataacaaagcagctgttcctttctgagttgtttgggtagtctttcagctgtgacaaccgaaataacgaagacataccaggccatgggtgatcgtctgctcgaaacgacgtctagtgagcaaaatgaagagcatcggaaccaagaatcgcacgcaatgtatttatctgcgaaatgccaaaaaatatctcatggcaatcatcccgaccgtttatgtcttcggttaacagacgttgaaagttgcactaacgccatcggaccccgattttagcgtgctttggagtgttagtgcgcgtgaacttttgctttgaacgggcatgtgcgatattatagagatagagaccgtcgtgaactggaaagtcaggtctgagagctcatcttgagaatcgggcatgtttactcattagtggagtagcactcggtgattacatcaagaagacattgcttctactcgtcttgccatgagtagaccaaactagttttcagatagcctcgctcactagcttctccacctgagtgtaaacagacggagaaaaaaaaaagaaagaaaaaaactgccgcaacataccagcggcgtgttacatgagccatctcgtagtgtgggagtttcttctgaagaattgcgttgtgttggtggtgaaaataacagcatggttgccctagcagaatatgagcacttgaacagccctagcagaatatgagcacttgaacatttttggtgccgtttggggggctgcttgcaagacccttgctgcgctaaaactagtctgtcgctatgaccgtgctcataaccagggtctcgttactcgctgttgcgtcatcatatggttggcgggatcaatacagggtgccgtagaggacagagatgtgcaactgaaacgcaggggtggcctcgtttgtgagggtgcagagatagaagtgagggagaggatcatttctgttgtccttgaaatgaccacgtggttgaggtggtctttgtccaagaataatatatgtctgtcgctggtatattagcggtgtgcatcgtagtggaggttggaaatttacttacgcaattgttgacaagataaagccacttgaagtattatggttggaatctactgtataactatctctcttgaactatcactatgacctataacagaagaaatgtacactcctagaccctagaaacgaccctcatgtcattgcagtagcaagatatctaccagatcgtatctcaaccacctggatattacgcaataaacaaattaatcaagtttggtcctagatgttcccatccaacccccccccacagtattcaaaccccacaaccagcttccttgtcgtattctcctttcctcacactgacattccggatatttgcttaatctctgcacaccaggtccctacagtccaatatacgcactctgcgagatttgcagaccagacccaagacattctcacaggtctgcagttcttactgtccttgtacctagagatgaaacaagcaaacagagagagaatacgagagtctccattgaccatcaagccatgaataatatcgggcagtggatgttgactaacatactacggtagccctgccttcttttagagcgcatgtacgagaactggtacatgctgtgtgggtaccaccatatgcttgatcccataccaagtagactccaagacacttgtatcaggtgtaccgccatagttattagaaaagtgctttggactcagtatccctcacttctaatctacagtaccgtcagctccccatacctttccacaacccaacacctctcaaaaataactttcgtctcatgctgcaccgttcataccatggcgcatacagtccagaaaatatctcttatctctttcagataagccaatcaatgcgttgctctcaaacaatgccatctaggttgtattaccggcaatcgatttacgagcacagataccgatactcgtacatacttgtacagatacaggcacaaagccccacagtaatatcaagccttgagcagacatacataacattaaccccgggaacaatggataagaagggcacaatactcttgagtaataacagcaacaacaacaataaccatttccccctcccgtctgaagcctttctggccaccttccaattgcttgtttgtgtctctgtcggtactttttcaggtcttattcctttctttttcaaacggctcgttctcacgccattttcgcattcagtatatatgaagataacggagactaagtcgctcaattgtcaccattttgaaaatctgaaaatacatttgtgatctgcggcttccatggatcacaatgcgataaataattccgctaccacataacttctaaccccacaaatacaatctctgattacccctattgagataaattttatgcataaacatgcacacctgccattgggtttgataggccgttgaacagagccagggaaatacgtcacgtcacgtcacgtgaccttcgaaatcgggaagtcacgtggtcgtctagtttaaggcgtacaagttttcgttcaggtgacatcatctggctctccggtgtgtttacacaagcagcttgtagtcgccaacatcattccaatacatccagtttttttcacatcgaacaatagtaaagaaaacagaatagtcaatctcatgacgttgactcatttactacctcaaaatcttcacaaattatccacttttgctacactgatctgaacgcgtctccaacagcgctgactctcttttgaccactgtagttctcgcggcattgctctgaaagcaaaataacctctaccactatctttgccatgtcaacacgaaaacaatgataccaagaaaggtttgttgtaatgaatccaagggtcagcattgccgttctgctgagccattgtaatgtgtctgtatgcatctcgtttcggggtgattagccgtatattgaaaaatctaaggttcaattcgtataacggtcttgaagctaaaatgtggagagagtggggaagattgagacgtctccagaacggcagggggtaacgtgacctgtttgattctcgagcaagtctcttaatgagtttattttctcttttacaatgcctattttgtcttcagaaggctctgaagttgttttcaggtatctcgtcaggaacgcgcgttcgctatttttcacctcggcagaatcctctgttctagaagtgctgtaatattgatttctgagcgaagtgcgtggcaccatcgatgcaggtagggtcctataacattttggatggagattcggcgagtttcatgctttttatcagggttttggagggtgctgtattgatgtggggaggtgttatttgtatgtttaattaggattacttataatatgagcggtttagatatataactttaaatatttagtagtaattggaaattgattcaagtaaattcaaatgatattgttaagacgagtggaagagtattggtagggcaggaggtcaggagattgagcgtctagagagggagtgagtgagtgacgccatgaatggagactttttatccgactgtgatctacaaatcatgtaatagctgtctatatatctcgttctgtcgttctgctccatatggatgggaagctctacccacaattgcgattcgtcatcctcttttagacgttattctttggattctgcaagtattcggactcatgatcgactactcgtaattgtacaatacttttactcatacttcatcgtagtcatgaacatgtattggttcctgtactacatacagccaagagtcagtctcatggctttcgacctcaccgacatctttcttcttatattgagacagaatctatccaattgaccatcatctattgaccaaatatcgatagactgccgtgtctaccatgcggacatttattgcgacacttcacccttcgaatcttagggaacatactctacataacagtttttctgacgcacactcgcacactccagacataccccataagcggcatctactcctgctccttcaatctgacttgattacactggactccgcaatcatccccatctccctaactgagcttttgagtcagatctcgcttagcttaccaacatctccgattagccgcgatgatcagcaatgggacgttttaccctgcaaccaacagacagagggctggccatggaacgagtgtttgtttttgaccttctcctcctcgtttcccggaaacgagcacacggcgcccagaccctgtcgaccctgctaacccctatttatgtctaaacgcaccagcgcatagtttgacatcgtcgtatccgcttcggcctcacctgctcgacctcagaccagaccttagccgcgatggcttcgtcttgtgcgtatgacatgcaatactgagagctgtcaatgagtacgttgataggaatgtctacaagtagtgctactacggtatagtcacgcgagcaggcttgagactactgtactgtactgtagcgtagtagtgagctttttctccaggggcctatgattccacatgtgtgatatccacagatacatcccatttcggacccgtttcaacctgtctcgcagcagttgcttttttcatcgtctgcgcgctcgacattaacaaaaagcaactatacggaaacattactttttgcatcgcggtaatgtacaagtacatactgtacacacccgtagtgtgactctgatggagtaatgtagatgctttttgaaaacagtcgtcgaagacacggagaatgagagagatccgagtatgacttatagatgctactactggtagtgtcaatccggcttatcgtataccagtatgagtacaagatggacacttggttacacacctgtcttaaatagctgtgtaaatgaacaccaacgcatattcgggtgctcctttagactcgatacaagtacatagatcgcagctgatatctaggtctggttatggtggtggctaaagatgaaacgagagatgtgcggatctgtttcaacttgtaattcgggctagtgtaggtacagtacctgctgtaactcatgtgtcaggcatacttgaagatcaccaagctgtagagcatgcaaagtgtatgtcgagtattgaagagtagtcggaaacagagtgttccatccgggctcttccagtcagtcctagactttcctccttcataattgacacgtcttcttgatgacttggtaccttgacaatattcgtcgtgtctctctggtcaattcctctgttcttgaaagagttatacgatgagctacgatggaacgcagactgagttcacgatacttgaagtatctaactagccaaataaaaccactccgtttaccggaaagagtacgcgtacttgtactacagtacttgtagaaaacaacgctggggcttatctctgaaaattttgctttctttctctttattgttggttctttggtgataatggtaccgtttagatatatatttttatacaataaactctactataaattcactaaaaatttactcgctcaaccagatttagtgggattgtaaaatatatacttaccatattagttgatgtctccatcaagcatgcatgcgccgtgacttaccatcaataatacctttcatggaaggaggcaaaaaagaactcttatgttcattgctgacaaccgagagattcgaactctcgcctccgaagagaccaggatattgattcagtcacctgaacctggcgccttagaccactcggccaggttgccgcacgtgaactggttgcgcttggagctattgagggtgtcaaatatcgcaatgtgtagcaattatatatataaaaaaggggaaaaaatcacaaaatagatgcttttcttgccgaaacaatcacatccagatatgatggagtctcttctatcactcttcctcttattgaacgtccattgactaagtttccgctgaaatcacttctggatgtaccactgttctcgtcaaattcgataatgtggagtgtattgtattttattcactatatttgacaattacttatctcaatgttttttatacaacacgctcataatcctcgttcctttggaagtggtactgcaagcaaatggagagtgtttagatgtgagaggtccgcttttagttagcttgaggaaatactcaactataatacttgacattcgccgtatgtctcaactgtctcgtatgtattgtaaaaaaataaaaaaatgttccagtattttggaattcaaacgcaccgcaaataaatacccaacttggactcgttcctgtcttgctcaaattgaccaatgtttcttgtggtatgagtacaagtaccggtattagaactcacgttcttgaattccgctgcttgaatctctttttcgtgtaaacacagttcttcaatgtgcgccatctcaagtctcaagtctcgacatcgcatctcctgttggctacagcctcctcctactaaaaatacaataaacagatacattaaatacgtgtgactgaagtcactcacgagccttgcacaccggtgtcgggccaagcattaatgggccgtaataaataactgagaggatagatgtttggagatgcccggatgacttggaatcatatctagggcttcgaatcctggctggctcggtctcggcactcaattggagcttaagaagtggagcagcccatccaggcatgggcacgcacgctgaatatctgctctcatgaccacaagatccgaaagccgatgttgaatccacacccactaataacaacgaacgactttccgagtctgtctctctacctctttctaccctgtttgcactcatcacagtaccagttacccttggggggcgagctgaggcccaaacaaggcaaatggaaccactcccgggtgcactggggaccatcacaggccaccatttctccgtaggacacctgttcacagtaacagtagaccggttctccgtcgtcctcctcttcctccgcggccttggcagactcagcagcctcctgcccctttctcgatttgttaaccaaacgagcagatctggtagccgaagctgcgggtgtgtcgtctgacgatggaggcgattttctgtttccaggagcaggagaagccttggcagcagtcttccgtttcttggctccagcagcagcggcagaagaagccacggtatcggacactgaagcagaggtagcggttcgtttctcgccattctttttggctccggctcccacggcagctgcgccgttagtggctgccgccttcttgccgccagtctcctttccactgtccttgcctccctccttgctgggagtgcctcttcgtcctccattaccgcttttctcggcggcagcagcagcggcagccttcttcgcagcaatggcttcccgccgcgactcgcttcgctggctctgtgcgcttcgctcggccacagagggcttgacatccacaatgatggcaggatggtcaggctctccgtactgaatcacctgggggatctcacgtgaagtaattagctcataatcggcatcaatacgcgaaatgtgtcgtgccaccgcttcggccgccaccccagccacgtgcattttctcctccaaacagggcatgagctctcgaatcaaaccccgaatctccagcagcatgttttcccgttcttccgttttcttcgcgcactcggggtcgtccttggccgccggtggaatagccagaaacttggctatcagatccgccacaagaggagtagtcgtggtacatttcgcgtcgatttctcgcagaagagtgaaatgccgcacagtctcgagcggtaaggcttccagagcatcagtgaggtcgttgagaccaggatacagacctacgggcttgtcttgggctcggcgcgacgacgatcgagtgttgtatcctttcatgacgtgtggtgtgtacaagttatgatgtcggagaaagtgacctgcatgaacatgcatgaggtagggtaaacgaatttcggtgggaggaaatatttttaaagttagccaatattgctgaggttaactaaatgactatttttgttgacctttatacttgagacgtaattactcagtataggtactgtacgagatttatgggatatcatcgatgcaaggcagtcggtaaagcagctcgaatttgataatagttgatcattatacggatttgcagtagtagcatggcaacaaagtcaatagggagaaatactacatgtaaatacatacgaaaatgaacgtcattccctacggcagttgccttgccgtgtagtcattacagtatgtctcgaccttcattccagaacccgagagctccatgagaagaaccctgtgagactcgtactaccacaacagtactatacttgtacttgtacgagtgtgtgagcaacaacaagtaatcaatatcaatgagcataccaatggctactagtacttgcacccaaacgtcgcgtctacctacacctaccagtatgtatacaagtcattcagctataaatgtctaagaaatacagctattttggggctgacatttggcaagcagcccggcggagggctcttccatggcgagtcagaaaacattgtctccctctcctcgtcgtctacacgacggactcagcagctggcaaggcagctcgatcagtttcagtatggacctgctttcgtggtcagatccacgcaccacgttggtatgtggcaagcggcccaacgagaagcgtaacaccacccactggaccacacaccaccaactaagcctgtgaagttttcatcactggcagaacaacctgagaaaccaactatcggatcctgaggttgcgctggaggtctaaactctctggtagatcagcaggtatgcggtcttgtcgtccttgccatcctcttccttggcgtaccaattttcgtttcgaatggcctcgatcttcacatcatcgattcggtaccacttggtaccgcccacgagcacgttaacagtgtagtgaccggtggtagtgctggttccgtggtggaaaacaacacccacgaggttgtactggttggacttgcctcccgaggctcggaactgctgcttagccttgagagacagcgactccatggggacagacaggtccgcgccgtacgaaatcttcttgttgatctttcgcacctgcagatccatcaggtcatcaccgcaatacgtgaaccgcttgagctgcaccacaaggattcggggtagttcttccagtaacgtctgcttgctagcacccgtgatgggtcttccaccctctccgaacgtctccacctgctctttggcagacagagccttgaaaccggactccacggaagtaatgttgggattctccacatctagatggataacatggaagggctccagcaccttggagacggactgacggggcacatcgaggttggattcaaacttgccgccgaaaatgtctgacacgggcgaccaggggaactgaggcgatcgggtcgtcgagttcttcttggctcccacctgtgtccattcagcgctgccggtagcaccctcctctttagcagcagcctcctccctggctccaatcacagctacgaactcctcatgcaggccgtcaagcaggtatccaaggaactcctcagcatcctcctgcttgcctcgctggaaatggctgaaccggggcacgctgacaatgctcttgtaaaaggagtcaatggtgatatcgggcagcttggaagtggcaggagtggatccaccgtttactccgttaacggcgcctcgcttgtagtcgtcaaggaaatcaaccacagcctcagtcagaggagaatcgccgtcaagagaccggggcaccttttctcgaatcaaatcaatcagtcgagaaaagggtagacagtggacgagaatctgcagaatagagttcatgaaacacacgttgccgttgttaacaatacctcgaggtcgagcagtcaacaagctgtggtggttggtagaagtggaagaatcaaagagttcagagtcgtaggaatgggccttgacagcagcgatgatggagccaagagtggcaggaggagcgggcgaggcagtgggagagtcggattcggcagagtcctctgtagtagcatcgccgttggcaactgcactggactcgccctcctgggcctccttggcgtccttcttctcaaccttgggaacagccttggatgctgcggccgcccagctgctctttgtgggcttggcagcagcgacaggagcctcatccttgacctccacctttgtctgaaacttctgggcaaccacaggctcgtatttctccaccaccaggtctgcgctatcgcagatggtatctccaatttgcacactgaagtcctcgcctcgcacatcgaccaggcgagaggtggcaaacgacacaggctttgatagacgaagcttggaggcacctccaagaggacggacttcaaaccgacctccaatgagcacgggaagctgtggcaaccggttgttgtccttgataagctggaaaatcgactcgatcggggtatcgttggcgttatagtaggaaggagcggacgaagagttcacagcgtatgtgggagtggtggaaggcatgcctgcgggggcagcagcggcagcgggggcgttcggagtgaacgacggtgcgccaggtgtgaatggagccgttgctgcagggctaaaggaagcgccgccggggttgaaaggtgctgctgcaccggggacaaatgcttgggggcccgcaggtgctcctcctccacctcctccactgccagctccgcctggagtgaatgccgcagcaccaacgttgaaactaaatgatttcggtttccttgcctggttctgctgatgttgctgatgctgctgatgctgctgatgctgttgctgttcaaagtcgtgtggcggcggtggctgcatcatgtgtggaagcggtccttggccgggctgtggcggttggccagcttgcggctgtgactggtggcccatcatctggtgcatctgcccatctggatagtagtgcatgaagggcgcctggttgaatcccccatagtagggggggacgggcatgtatccgttggggtgatacatcattggggggtagccctgttgttgatagggttgtgagttcactgagttagacgcatttcggtttagagaaggagggtatgtgctggcaaaaacattggggtatgtgtgatgatggaattagacacattcaagatataatgggaaagcaatatcggtggctttcaatcatcagccatcctcatgagtcgacatatcgtccagatgagactgtgtggtggagctgttgggtcagtttcgacaggcatcgacatgccgacaaggcaagaaagtagcaactcaaacaatcattgatcatcattcgatatcatgaatccatcacattattgattcactcatttgtgcgtgcctgatttgcttcgtctattatgtgtgactaatccaaaatgcacctggcgcaactgagagatctgtaagtggaaagcaacgatagccaacgacagtagacgatgaaaacggtaataataacgatagccatgactggccagctctcatggtgatgataccttaatgacataaccactggtgaagattgatgaagacatatttgcccataggtcgctcacaacaagacgagcctccacactgacacatcacgaagcccaccaacctagcaaatcaccatcgtggcgaaccaccatggtcgtcgtcatcaccgttagtgtcgtccaccattgccaacgggtttatgtatgactgttttgatctgtgcctgatctggatcacaccacccacacaacacatcaccacgacatatcccatagatcatacacatacggtggcatgaatgtagtgatcatccatcgtaatgccacgttgtcgtcattccatcgtcccacaaagctcgtgtatccacagcaatctccctcatcccgcactgtcccacatgtcccacattccgtctcacattccatcaccccggtgatgttgctccacctggagtcccccacatactgctcaaacgaatactcactattatacaatgctgtttgggtgcgtctatcgacagatgaatggatggtccgttgtattagtgtctcggacggctgctttggagatagttgtttggattgatttccagttgtttgcgtattgtcgtgtttttatgtcagacttgctttttcgtggtgcggttttgagtctgtcaaaaagaatattcgggggcccgggtggatctatcacgtggcctcgtgtgtcgtgtccgaaaaatgcctttgctaggggaaaaaagagtgctgtatacacagaaaggacgtggatgagaaattggagcttgcacttcttggagtaaaaaaaggattttgggcgactttttggatgctcccaaaactttatttgggtgggggagttagtcagctatgggccggggaatggggctatatatcgacgttcccagtgtcctagaagggattggaattttgggttcggatcgggtcgtcataaagatgactttgaagcaaaaaaatccgctaaattcaccctggatcaccctcaaatatacacacgtacacttctttccacaggtttcgttgggacgaaaagagccaaattcgaaatttggagatattttatatttttgcccgtggacatttgggaccatgtgaactagctagggagagcgcgggagccaaaacacttgttgtagacacgcgactacgtttcctccctacagatttggtgtttttttcgtttttttcgaggtctgctgactaagagatggggcaatggttcatgtcatatctcagttgtgctgggtgaaaaataaatgtcttaaactcagaccgaaccttcgcatgttatatggtgaacatgattgcattttgataacgggttgtagtacgagttctagaggaccatttggtatgttgacaacttgtcagatgaaaaccagggacacaaactggtgttaaatccaccatggtaatcttcatgactctgtgatcgtttctatatggtcgtcttctagtttcagcccacttcagctcctccgaaaaaatatacatctccgatcgtccgtagtgggctgacaatgtgtctgccaggactacggagttcgtggaggtgttgaaacaggtgtaagaagccctttggagacgcactatcttgtttaatgtgttcatatcgtccgtcgcggtgagtgttgaggatctcgtaacatctcgtcaagaagcacagatagcagaacatgtaaagagtctggggtcatcctgaacgtgcttgatctactgagtaagcccctttagtcactcgtcgatattcacctctgcaggatgtcgtatttgttagcgtctacatgcacactaatgtaaggcacattcgaacagtgggcgtgagatgtcagtgtacaatggaacaggggaagcaggtatttgatgggctattactattgcccatgtgtataacgatgaatcatttgactgggtattcggtgatgctgtatccttatctttgattcacatttcatttttcaggtatgggtgataaaaggggtgtgtatggctgtccaattactaagagaagttgtcaaccgtttttgaagagctcaaagaaaaaccccaaaacatctcaatgtccacttttcaaggtcctggtggtacatgaacattcacaatactcgaagctacataattggtttattgcacaccctcacaccgtcacttccaaatgatatatctacggtacactccaaacataaaatacgtagaatacagcaatagagagagctcataaacacaagagagatacccctggcatcgccgacttccactcaagatcctaatattaccaactgcttcattcttgctgacactgcgagtacagtatgtactcgtactatgcaaacacttctcagaaacgccccagagcaagtctacgaagtaacaattctagtggcacaaaatatttcccccgaacactctgtcatatcctcgttattcattatcgtacatctatcactgtctgtcgattacaacagactatcactgttgttgttgtttgcactgctggcgttccagttgatgttggaattcatgttaccagagcttgtgtttgtggttgcgttgttgtttgtgttccagttcaaagagccgcccatgttgttgttcatgttgttcatgttgttcatggtgttcatgcccccagtgttcatgcccccagtgttcatgctacccatggtattgttgtttcccattgggttggagttccagttggaagtagtatttgagttggagctgttcgtattccagttgatactagaaccagtattggaattgctgttactgttccagttgataccgctgccagcgttagaagtaccgccagagcttccgctgttccagttgattcccccacctgtagatcctgtgttaatgttgtagttggcagcaggtttactggcagtcagagtctgggattgaagaggctggggctgcagaggttgcagtggttgagcctgaagaggaggaatagaaggctttacagatgactgaaagttgccaaagctattattagaggtgcttgcactggcaaagctgccaaagtcgtcattctgctttttgggagcctggagagcaggaatcgaagagggaatagaaggcttgggcgtgacgacagggacaggggtgacaaagctgggtccgtcgtctagcatgaagtcgttattaggcttgctaggctccagggtcatacctccgataccagaagacatgcctccaatacccgcactgaggtcttccctcgatgccatgggcacttcgacgttattcgtcagcttcttcttctgctcagtttcgaccttggtagagaactgtttgatcacagtcatgaacttctcaaactgagccacggtgtacttgggacccacggccatggaccacagcactggaatgacttcgttggcaatgacatccacatcaagcatcttgacaagagtctcgtagagagacaacatggacatcatgactcgaggatctcgagacttgactgccttaagcatgccgagcaatttatctgtgacactgtgtttatccagaccagacacaacgagctccttgagagcattgatagcagcaattttgacacccagcgaagtggttttggtgaagacttcaccaatcttagggaaaatcttgtttttgatgatgggaaagtccagtttctctagaatatccttctggcacttgaacagcgcattctcctgcacttcgggggcgccagcgttgtcgaacatgataaagaagaaaggcagaatcgtcttctcgatctccttggagttgaggttcttcaaaaagatgtccagatcttccaggaccaccttttgcacatctgagttttgttgcaacttctcattgtcgcttagaatcgggagaataatcttgcaaaagtccagagacgagagctgagcagagatgagaaagatgacatgcagaagcgacgccatgatggcctcgctgacgtggctcagcgacgagatcagaatcttgagaatcttgttcttgagaatctcaaagggaaactcgggaatgattttgatgaactggggaatgaaggcttcaatctcttcatcggtcttgccggagaattcgtcaatgaacttcaacgacttaagaaggaaagagttgaagaagttggctgagagaatagcctgaatagggtacctatcggtggggtaccgggtcaaaagcttggggagaatctcaatcaaagaagctggaatcttggtggtgttgttgggctttctcaaaaaagaacctaggctcttgacgtcctcttcgtagttgttgtagttgttattcgagtcaataggagacttgaagttgtacaaagtgatggccagacacgccagagaaaagacatcggccgaaaaatcgaggttcttgtcgagaaccagctcaggtgcagagtaatccagattgatctgcacgaaacgaggatacctagcgtcaaactgcgggataaagaagtcacgtgattcagaacccgccacctcgcatgcgtatccacatcctccgagcttccagtctccgagggagtccacaaagaccgtgttgaggttgaggttcatatgcaccatcttggcgtcttcatgcataaacttgagaccctcagagacttgcagaagacccttctgaatcacaagaggtgacaactccggaggtatatggtcacgtgtagacctcgagtcacgtgacgcatcagcctcgaccttggctcggatacaggtctccactcgttcagtgacaaagctgagggagctctttccctcgtagagaggttccacgatccgcaggaagtttgggtgtcgtaatctggcgagattggtggcttcgtttcgcagtctcgaataaatttcgtcacttcccttgctgtttttgagtccgtttttcgagcagaatgattcaaactttttcttgtcaaaggtgaacacagacacggggtcgtttgtggtccttcgagtggcgttgtggactgcccaggctcccgcgtgaaatgcgggctccgaggagatgttgtagttggctgagtggccggatttgactgagttagcacggacttggggcggaacgtgtgatataagttcttcgaggtagtattatccgtcatcgagactcctccaattgctgcaaaacataccaagtataccaaggggagcttcgcagtcaatctggtagagacttggaggaacagatggaagtcacatgcgatattttgtattttgtaggtgatgttcatgtggtcaacgataggttgggttccattagaagtaggtagagatatcaagtaacatgatctcacttgaaccatcgccagattcccaatgaatgaacctcactctcactctatagtgatctgggcaagaccgaacaccaacccttgacagctatatgccaggaagaacacctaacaaagcaccaaggaccgagatcagaagatcattggcagaaatcaagtaaaccaaggacaattggacacagcagccaagacctccgaacaccctcttacctgcccatctgacaacaatgcttgtagtccaaacctactatagagaactgtgaacagatgtaaaactggaccgaaccaagtttcacccagttgacgttcaaaagaaagctctgcccaaaaattccataacactcttaactccacctcaacccacacacacacctcataccaagtacaccctatcgctgttggcgaacagaccacctttcattgctctcgcaacccttcacagtggattcccctagccgcagacaactccaacctccataattcacactcacatcccagaaatcccagcattttgcaacttttgcagcttgaggtcgtgctaaacggtttgtgcaacttccagcttccgtgtcacagaatccatgtccatggtggcagggctgcagcactaaaccttattgcttgaatttgacagattatgagagattgaaaattggactggtctaacgaatgggtcaatcacgtgataactaccgaggaacaccttttcctcttctgtcgcaaacacctccattttctacccaaacccttatcaaaccaatctccccgcggatcgacctaatccgcttacgtggcgcctctttgatgttagggttgcttccaggactcaaatgatgggtggggttagggcaactttttttttctcctcgccctcgctcctcctcccctacagtaccctcccagtaaatgccactacgagtagtgtttctagggttagggcttctacgcgcactcccaaagtggaccatcatcactaaaggctgtgcatgcatggttgctgccagggtcgtttcaggtctaccgtacttcggggatccgtgcgcacacggcggggtcacgtgacgcctactgagcgattttatcacgtggcatcatttgacctctgcatttctttcggctgcgacattcgagtctggatgtacttgtagcagccacttgctcggtttttctacttgtagtgcaacggctatttttagtatgttttaaatcacgagttggacatgttatgttttttagggtgtgaaagaggtctaatatgggagttgaggatatcattttgttctctgacacgctccgatatcgattccgcctttacatctcgtgtaccatcagttttggccctgttaacacttccccttcccttgtgacttctcccacgctccttgttctcctgttgtcgtgttttaaacctagtttttcatttctgtttctcccatcccttgatactttttgacccacacactcttgaactcacactacacaccctctttcaagtcaggccggcccggactttttactaactactaatatctgtgctggacgcggataccgagagtgagtatattggaggttggggggaagggttaggagagaaggagggagaggttccgaggacctgttgtgacatggatgatgacattgattttgacgttacgttttgtaggggtggaatggtgtgtgggagaagtggaggagacatgggtgtgccactaggcagtttatgccaaatacgagatatcatgtcgctgtgttcttcgttctgtggatgagatgagctgttattgcatgataccaggaaggtcccccggtggtgtagcctggggtcccaggatgaagaggtgtagtttgacatttctatatggaccctttcacgaccatggttctgagcatctggaacgtctttgagaactgttgagcatttcaactgcctgtgatacctgagcaccttatgaacacactgccaaccgcaaaacctcgtcagtgactaccgacagtgagctgaggaacttcttgatcgtcacgagagtcgagatgctacctgagaacagtggatggatctactccgactgagaactacgaattcgactacgacagtgactattgcttgattgtttcaggtgctgcctttcatgcccgtccaaaaatacaagagcgaaaacgactaaaaaatcctcatctacgataccccattaatatctacgaacacgtcccctctgtacaactgacccccatggtgttgtccgctcagaccctgcggccctcgttaccagtactaactcagtgtcacaagcgtgcccaccccaagactgcacgaaatgtgcttccaacgaagtctgcgtgctcggagttgcctcccaagacaacccctgccccagcatcacatgttctgccgcgatggccaacaccaacaccgactcgggtaagtcgtcatctggtacttctgctggagctattgccggaggagttgttggaggtgttgccgccgccgccattttcggcttcttcgtttggttcttctgcttctcgaaacgagcacagagagtcagagaagagaaagaatggatccccgtggtcggccaggaccacgtcacagacaaccacaccgccgggcagatgccaccaaaccatcgaaactcgtcgtcgacgtttgcctcgctggcctcttcggccctgtctcgagcatctaacgtcattcccatcgcctacgttcctggtgtcacgtcacgtggccaaatgtctcgtgactcgtccactggtggaactctcggttccaatccgcccattcccaacgtgccctgggagtaccagtttacgcccgaggagctgctgcgtcagtcgcgccaatcaaccgtatacggcattcgagattcggtcaacacagaggcttaccgagagtctcaggcttacgttagcagtgcgatgatgacggccattcaggctaagcccatgcttgtcaacgtgaaggacggccatgtaactaacaacgatgggagtgcacgtgactcggctctacgacagtcattcatgtctggaacctccgacggctctgtctacgaggttgccagtgccgagcgagtcaatgcccggtccattcgaatcggaaaggcccaaagagtcggtctgcaaagcacatacatcagtgaagagtcggaggaggaaatcggaggaggagccagcaggacacgagactcgactcattctgcagctgtgcccattggtcttgatcggcccactcttggacgatcgttgaccggaaacagtggctctggcgtctctggcgtgagtcgcaagtcggaggtgcctcctctgcctgctgctttggaagtctcctcttccgaggcaccccagttggacgaggatatttttgctggactcgacattcctgtccagttgatcacaaccgacgacggtcaagagtctccttttgacgataagtttcgactttaagcgtggagcgaaccatgtgacgagtactcgcacacttcacgcacatctaacgataacatgaacacgttgatacccggctcgaatacaggtatttcgagtcgctgttttttttttttgctgactgcatttgccagaaagatgaccggacactaagtaactactttatgagtttttagattgcatcgcacggggtgctataatgaagtgattgtaggctgtgtagaacggagcttgagggtctctactggtagcccgggaagagtggtgctgtaatcagaatcaccttgtgaagtgtactgtagtatccatattggagtgaataatttagagttcaatgggggatgttttcacaagtctataaaaccctcgaataaggagcgaaactagaagaaatttctacaggaacagcctaccacagtagcgagttgtcagtagcaccaactcgtccctatctcctttatcacatccctcagatggactcttctcactaccctcatctctctagcaaccttaaatctcgtgtctctctcccacatccaagaactgcagtctacgaactctctcgatccttcttcagcatgtccaaaacgaaattccagcaattgaccaacaaggctctggctgcgttggccctggaatgtggcttgagtaagtacctctcgagagtggagggttgatcgaatgaatgagacggtccgctggaaccaagataccaccttttcgatccatactatgataccctgttgatgccgtgctggaggaggcattgcgtgaaatacaccaacaaaaggcttcaatggttgattctgctcaaatttcacacccaaacctgtgtattcagtgtctctattcgtgccatgaccatacctgaatgacctaccacaagacagggcgaacatagctacagccgactgaacatgacgtttgttgttcataaatgtgtcacctactcttttgatcaaaaaaataatttactttacacactaacccagaacgctcaggaacaaaacctgatctccaggcaactctcaggtcagtcgtagactctcctccagtcactcctcctaagtccttgcggataacatccatcgatatgggtgtcagaaacctgtctgtatgccaagtgacgttaggaagaactagaatcgagaaggagaacgcagttacacctacatctactgttacacaagacgcaaaagtggagaagaaaacaaaagctaccaaaacgaagacaaaagccaaggattctacaaaggacactacaccagaacccgacagtggtgttatttctccgacaatcttatctgctgatgtttctgtcgccactgtttccacctggaatacacgtgacatttctgaattctccacatctccaggagccacgcaagaagacattccatgggaccttagaaacgactcgttgctggaagtagcgtacaatttcgtgtcacgtgagcttctgggcgacaatgtacgtaagaagccccatgtggttctccttgagcgtcagagacatcgttcccagggcagtccttctgttttggagtgggtgttccgtgtcaacatgtttgagagcattctagcaggcacagtctacacatacaaacagaggtcacatgataaaaaggctgggacacccgagaacatcgattctgattcgcacaatacagatctgtttcgtgtggatccacgaatggtggctgattacttcattcggggcaaacgagccaagggcaagaagttcgacatcaaggcagaaaaaattggagttgttggccaatggctggaggccgagtcacatgatctgcctgagtttgagaatatggtgaaaatgcaggccgtcgctgagaaacccaaaccaaagaagagcactcggaagaagaaggatgaggaagcggaggtggtggaagagataaaaccactagcggaggaggaggtaccacgagaaacaactcccccgcaacctatggaacgtaaattcattccacgcgatctcaagagcattccggggttctctcctcttacgcctcaactacattctctggcttctcatcttgaggttatgagttcgattctggcaaagaagcgatacaacagtgtcaagtcgaagaaggcggatgatgtggctgactcgttgctccaggctctagcatggtacaactggcaatataaccgagagtacttgagagagctgcttgagaatgaggatgatgagagatggcttgaagtgaatgcctgggttaaggaaaatgttgagtgaacagcctaggtcgtcacgcgaaggattcacatgttcgaagccaacaagtagggcatgtgctgaacagagaagcatcgatgaacatactcctacaaatataggaaggcattgcaatgacatttgcttgttgttggtggtatactcacgtgatacagtcaaaaaattcacgcaattttctgcgctcaacctccatacagcaccgtagcattagcctctgttacatggtttgtttaggggggggggtccatcgtccatcaacaaaacaacttctctcgattccaaggaatgaagcagccacatgttggaatatcgagctggacgtgggaaaccgagcccaccttctccttgtttttgctcttagtgcagtttcttttacttctagaccaatgacaggtggaataaggagatatcaaaacagagatagatagcactagtcaggatggagtgaatggtcaactagaatggacaagaggggagaggaaacatgggctagcattattacccgttcaagaagtaacgtaaacatgagataactcctaattttggaagtatttggtatcttgtagtgtctacagcagagtacgtaccgataggcctatatagccacatacaacagtgacgtaactctccttgagctacgaaaccaccactcaccaggtagtctcatcatcatagccaagcatctattgaaccctaccagagcttcccgaattcctaacgttggtcccgtctcgctagcgtctatatcgcgacttctagagccgttccacaacattgctccaagacgccagaccgtcggcatgctctgtacgagtagatacacaaacagcccagaattattatgctgtgccaaagataccctgattctctccccgtaaccacggtaacctctttccttgcttttcgtgtgctccctgtagcggcggtatacaccctatacctgcagtgtctcaagagccatttggatgatgcaggggacatcttgagcagatgttcattcctgaatcatctgagttgacgggcgccactacgggtttctttttcggttgccttttgttttttcattccgccgaaacgtgacttgttttgatttctattggtatctcatggttggtcaaaatgggttagaattcaggggctccaaaatactgcgacttgtacatggtggaccatgtctagcaccgcaaatacgcgcaatctgtacaggagtcgtactctacgttcccaaaaaggccatcttttggctcagacaggcaagatggatataatattcgcgaaaatgccgacatgtagttatacaagttttttttatttttttagccagaccgactgacacccgtaaagcagcacaacgcggtgtgcaaaaagaaatataaccaaaagtcagctctagatcaagtacatactgtaccggtgcgagtagcggtggtgctcgttgccgaagtctaccaaccaatttgccccctaaagctgctctaaattgagtgtgagcgccgtttacactgtaaacatctgggcgaggaatgacccgtttgacgttctcaacagcccaaacgtgctaccagcaataataatgacattccggagagacttacacacctgggcagccaagcacagcctcgtcacgtgccggtcttctccctgactcaaatgtttccccattcgtaaaccgtatcgcacgactcacattctccacaatgcaggaggccactgtaagcgtgacgcgcgctgagacattttgaaacggcggccacgagcagaggactgatgggtgaaatttgcaaaaacagcggtaaaatagtagccggttagaatcgcgtggaatgtacttgctgtgatttttactcactttttactcccggtctcaccacatattatcgcatctccgagatctggctgcatgtacgcgtcaaacgctaagtttccgaatacgatattacgatcggtcagaatgggtgatatggagatgtaaaggctacaaagggtagatataaatgatatttggactccgcagaaaacatctatatgttcatctcagctgtagcaagttgttctatgaaaaaatcacccatctcaatttctctgtccaactctaaataagcactccgtttgacagttctagacgagcaatccaacttgtcggggatggtctctggagactgcaatagtggatctatgacgatggaagaaactcccttcctgaaactgccatgttcggagtacttaactgctttgaaaaagctgaaagacagagaattgggcaacgtgctcgatattcccacaaacccccttatttttccatgttacctgtctcgtcccaatcgggcaagtcgacactgtacagggagaagctaaagagtgcacagggtgataattatggggagcatttatttcgcgtttcccatgagctatcgaggtggaaacttgaccagaagactcctcaagagacactgagttgattcctcttttcaaaaatcaaattcgttcgttttcaggctctttttaccacctccacttttacgcccctccattttaactccatgcaccgttcgcttaatccgagcccttgattcagcatataaatgttagcagatccgttggaggaagccaaggtgcaatttgcaggttttctggagtgaccacatactacgacacgaactttcgaaactctttcagcccttcccggactctctacgccgaactacactccaggatacacgtttcttcgcttactaacacggctgtgagcagagagactcggtatattcgaccaccaactattttaaacgacagatacattgccttatcacatatctgtggagtatctcagctcagcaatcgaccctcgatcttatctgaatcccccatcgtttgtctgttacctcttctttacccaaagaggaagtaaaacaaactagaacagtcgctactacgatcgacacaattctactcaaacctctgagacacagttatcaaccatgatgaacttattacggagaaaagactcgtcaagagcaatgactctacccggcagagaaggtgaccgggagcgggcagctgcactagaggaacagatcaaaattttggccgaaacagcttctcaggctctagatagagtcggagaactcgaacaggaggttgctaagcagcagaaggagattgaagcatataagacggaggttggcgaaaagcaactgtgcattgaacgactcagtaatgaggtcggggaacttatgacccaatctgtgacatgccgtgactccaacgacgctcatgggactccccagaaacaatgtgcgaaatgcaagtcacgtgaactcatcacttcaaagtcagtaagcacccagactacagtagcaacaaccaccaagatcaaggccgaagacaccagagtcggtgcacgtgggcagaccgattcagctgtctcacgtggcggtctctctcgtgactccatccagtctcaggactctcataactctcatgactctcatgactctcatgactctgcggcccacattgagcacgtggctcgagtggttgttgcagaggagatgacacggccccgcggagtgtctacttcaacatcaacgaccgcggactcttcgttttcgtcgtctgtgcactcgtcgccatcacgtgactcgtcacgtgactcgtcctttaccgagttgtctgatttctccgacgacgacattggagctgttcgaaccgtgatcatgtcggctgaacaaatcaaggctgtggacagaagcaaccttgagcatcacgtgactcagctgcagcggttgctcaagaagagccagtcacgtgacgacgatctattccggatgcaaaagttggaagctgctctggtcgcagtttctcgggccagggctgttttgagaaaggcctgagttgacttcggtctttccaagtcacatgagcgataccctaacaatatttataagtacactaattaatgatttatgacagatgggtgggagtacgagtattttaggcgttttatataatctgtggtagctaccacgtagcgtcatgctcgtgttccgacaagtacaagtaagaggtatttgcggtcaagtagtacctgatggaataatgggaattgttacctcattggtgtctgtatatacagactccgatcggaaaatcagtcaatcaaacgcagatactcgaacatgtattcgttcaagtagatgcctctacattacgatactacaagtagaacattgctcttgtctatgatcattggaacataaatagcttcgtatcattatgtgccgatgacgcgactgactcgtgggcaatcgtagatacgcaatttgtttatgggcgtagaccaggactgagacttgtcattgagtgtaactgcgaaggtcagaggccctcttggtaaagccaagactattgatgtaaataagtctcatggctacccgcagacttctcaccaacagaagaagcgttacaaaagacgaggttgataccttacaaggcatcagagatttttaaaatcactgtttcatacttcaaatcaagagcgatactaaaataacagtacatactaacatgtacagttttagccgagatatatcctccatttcatttcattacatcagctgaatcagctctctctgcttttgtgctatccgcccatctccgcatctatgaaacgatatcaccatcaccaacttcagctcgtcgtattcactaataaatgagttccgataatgcacctggtcgaaaattatcggtcacgaagaggtctatatttttctagtatgttgttgacgacggctggccttgcgattatattggccaatgcgcacattcaagtattgctcgcagatcaacagaaccaagactcttgtctcaatagattgatattggtcacagttcaatcgtcaactactggcaatgatttcacttgtaagtgttggtcagtgctacaggtgcttgtatttgtccgctgatattgatgtctgccctgactaagaagtaaccatagaccatcttggacatgtagtcttgcttgaagagtgagtcttcgtatagtacccacgcttagctctgatttgatatctccgtacgctccaggggccgaaatctagtgctaagaacgggccaaccctcactggtaacaagttcgggactcggcgaggataggtggacataccctgtctattgtagtgagcacctcttcatgttggttctataggtcaactaccaattaccaatccaataccaaccacagtacgacgatacagaaccgtacacctgagaagagcacacttgtttttgatgccaaggtgctatgttggtccagacgcgattcaatcacaagggtattgactcgacagccattacgaatcagggaagagtgaaaaagacaatcaattgcacggatagtttccagagtccttttcagcaattctctataaaatgttttatatattctttctttttggaagcttaaacgcttcgcaagatctcaacatggagagaggagtgtcaaacgatgtattatgaaatgaaatgtttgatgataatagtatcattgtaatcttcgaggtctgaggattccgtatatctcatttattccctcaatatactgtatctctaactgacaacgacaactgtcatatttggggacgaaggggctttgctcctcatctcagaccagcaatacttacttgatctaggaattactggtagcaaaatgactttttcgaaaatcccaacaacatcacagcaatttgaacccatctactataacggcacggtgttcgaccaaattgttcatatttgtagtatttaaaccttaatacatttaaggcccggaaatggaggaattaaatgacatcgattttcggaggtgactctgaaaacgcgtacgtactttggcagcgacgcccaaaaaaatccccggagtttatcttttccggctgttgtccccgtgactaggactgcatctagcatgcgctgtggcgggtctacaccgcgacgtgataattgcaccaggcatcgatctacatttctgaaggagccacgcacccgacaaagcgatatacgacagttcttattgaccgtcgatcacgcaaggagtgtaaaaaaggagtttacaacgatttaccacgatttccacagttaccacggttctcacgtttccaggatttccacggtttatcacaatttacgaattgtacgacctactgcggcacctgttccttggaacgtttcccgacatacaattggaagatatatgcatcaagacaattagaacttggattcacgcacacactcacacacacacacacacacacacacacacactctctctctctctctctctctctctgagattgcatttcgtaacttcttcaacctggacggtgacatccactctctccactcctgtgtttctctgtgtaagcaacagaatcctcctttgacttgtcgaatcacgtcatggacgaaacgatacacaccctgatcacatccctagggtctatcaaagacccatcgacccgcacagcaacagacgcattcgagatccggacgtcgcactttgggaacctggtcactctcacgcaagagtcacgtaacgcgtttgtggctcttacctacttgttgcctcatttcgacgatgcgctgggtctgttggattccgccgagttcaagaaactgagcgatacgcgctgggaggtgaagatgccacgcgaggagtttcgtctagtcgatatccatgccatgttctgcacttgtcacgactacgctgttgcctgctacggagacgatgcgcagaaacaaatcgcatactttccacgccatcaaccgtttgacgaatacgctggagtgcaggggatatgtaagcatttggtggcggtttacattaggaagtactcgggtttgtttccgtcgtaggggttttcgacatggcgattccgtttcaagaacccgagttgatcaaaaggtcattatttatttactgcagagctatagacagcagtcgatgcagctgtgttgctcttacttacgtctttcttaaacctacttgaacgtttgttaatatcgtgaaaaagtgtgggcgtgtacttaactaaacttggagattcatctagtgggctactacttgagtcacagatggccacgaagagtactagtatcgggacaccatacagtcatttctcagatcaacggatagatgcatcagatcaacggattcagaagatatgactgaacatctagactacttgtagtcatctttctttaaattgatacgagatacattgactgcgacacatctatatgtttcctcatgtctacccataccatacccaatgataccgagcgttagctgacaatacaacttttttcaatctgacattttgctcaaattccaccgagtactctaccatcataagtcccttgttcagttaattacaccgtacctaccgcagttccttcgcgcctattttcagctccaagtgacgtgacctcagcatgtggaagagtgcccgattctacaaccgcggatactttcgacgtatgcgggaattgtgattggccagaaagaaaatcccacaattgtactgctgtttctacggctttcgttgttcgatggttgttcaatatgaaggttcgtcgtatctgtctccgcgctcatttatctgcagacactgcagacacggcattgataagccacagataaacagctatcatacttgtacgtcttggcggcaagttggtggttcggatacctgttcaatatcagtttcgagaaagaaaataacagctaacatttctttttctattgtacagaactggtatatctcctcagtcacaattgcacctctgattccatctgatatataggaagcctttgtttcagtttgggtttccgtgtctacctctctgatgcgacttctgatgcgcgcgtgcgattgcggcacagtctccaagagagccgtgcctttctctcagtgacaaacaatgacatacacccctgaacgtatatgatctaaaacgactagctcagcaacatctgtatagactctctgaattcatccaagaatcgtggctgctccgaaaaaccttagtgggcgtgccatcccggactcttaagcaccccggtgctgccagtacataacaatctcttcactcgtcctcaacctcaacctcaatgtcgctgtgcaacgacccagaggggtggcagctgctgaccaactactacgatgtgtctccatgcgtttcgcagaacgtcttcttcattctcccgggctcagtggccgcgctattcggtgttccagctgttgtccatctctactttcagccaggtaaacgtcctgccgtttggagctacacgttgaaacaggtgagtatctcagacgaagggtacagcaaaggttccagcacgaatactacaattcctacttgtattgtacagtcaatgttccatcgtgaatctccacacaacaccgtctcatactaacatagattcttacactcattcaactgtcaattgcggtttctatcccctttacgaccacgttccaacacgatctgcgccattggtcccccctggtgctcgcttttggctccattatcatcttcttcatccaaaagctcgagtttgagaaacggaaaccctccagcaccgtcgccctttctttctggggcctccagactctcgactcggccattgttgtctatgggcttggtatcagaggctttgacgaagcaacctacgtcgtctcacttatctcaatcgccttcctgggcctcttcaatctagtccttgagaccacatacagcccatcctcagagcctgccttctacgatgactctaacttattcgtcaaactgacttactcctacgtgagtcccattctcagcaagggaatcaattccacgctcaagatcggaaacgtcccgaaacctcctctggaattgcgaagtcagtacatcttcagggagttcagtgaggtgtggggaccgaagatcgacctatacaccaaggcagctgcaaaggaccccgaaactgcaaagttcccttccctaattgccaccttctcctacatccatggttatgattatctcaagatctcccttctgcaggtcttctcaatagtggtaccttttgtccagcctttgctactgaagcaactcattctgtttgtcgcgaaatataacaacggacttgccccgttgtcccagggtatttccattgtgtttgctgccggttcaatgatgctgttaagaaccattattgaaagcaaagaagaactcatgaccaacaacctcatgctgcgaattgaaacggctctcagtcagactgtctacgagaaggctctcagactttccaccgcagccgttgccgacacctctattggagagattgtcaatattctatccaacagtgtcaaacagttgaccagcgttgtttcttacctgcatatgatctggtctatcccccttcaaattaccatttgttggctgacaatgtacagcatgatcggcaacgccatgtgggtggggatggcagcattgctcttggttgttcccttcactgctttcatctccaagctgaagatgggtctgtttctggccatgcagggcatctgcgaaagcagatatactgtcaccaacaacctcctgtccaacatcaagtctgtcaagctgtatggatgggaaccaaccttttatggcaaagtagagaagataagaaacgaagaagagcttgcaatcgtgcgaaaaatgtcctaccttagcgccattgaaagcattctgatgagaacttgcaacaacctcgctgctaccgcttccttcgccttcatcgtgttgttccagcacatccctctttcagctgccagtgccattcctgctctaaatctgtttacgcgtcttcttatgccattcatgtttgttccctacattgtccagtttggcatccaggcctgggttgccttgactaagattaataacttccttggtctcactgaagttgaaaagttcaacggacaggagcacatcccagactcctccaagtctgtccctgtcaacgtcaatgggtcctttttttgggacaaacagctggaaaaggctgctttggagaacatttcgtacaccgccgacaaaggagccactgtgtgcatcatcggaaaagtcggggctggaaagaccgccactctgatggccaccctgaatgagctgtttgtccagaatggatcaacatcagtaactgggtcggtagcttactcatcacaagtgccttggattctcaactccacagtaaaagacaacattctgtttggatcccgtgaagacccaatcttttacaatctggtgattgaagcttgtgccctgacccatgatctacagcttcttgccgatggagatcaaacagaggtcggagagaaaggtatctcgttgtctggtggacagaaggcccgactttcaattgcccgtgctgtctattcacgtgctgatgtgcaactgtacgatgatcccctgtcggctgttgacgagcacgtccaagctcatttgatcaaaaacgtttttggacctggtggtctattgagtagcaagacagttgttgttgctaccaacacggttaacctgcttcgacactcctctaccattcatcttattgaagacaagacgtttgttgagtcgggagagttctccgaactcatgacgagagatggaaagatcaaaaagctggtggatgagttccagactcaagccggtgagtctaccccggatgccagtaaggtcattgatgccattgaggttgacgacaagcgtatcgagtccgacgctaaacacccgttctctctgcgtagagcctcttccatctcgcacttttcagtgatcactgttgctgacgatgatgctagacgtaccagagttgaagatgaggtaaaggaaacagaggctctaaacttcgtcgagctatacaaaaagtactttgttgcagtaggatacatcaacatgggggtgtaccttgttctctctctcgttggatcagccctcactatcgccagtacttactgggtggccgagtggggcagcgacaagatcgacctgagtgacattcagctagttcttggatatttctttattagatttgcctctgcactctttgaagcgtttggtggtctggctttctctacttttggagctgttcgagcctccaaattgcttcatgaacgaatgctcaaggcggtcttgagagctccaatgtccttttttgaagcaactccactgggtcgcctgactactcgcttttcacaggacatcgcaaaactcgactggatgatgaacaacttcatcacccggcttgccacagctgttatcacttccttcagcagcctagttctgatcgtcgggtcttccccttcaactctagtagtcgtacccccggccctgtatctctacagaatcattcagaaatactatctgatcacctcccgacaggtgcgtcgtctatcagctgcaaccatgtcgccagtggtgtcccatttccaggaaaccctcaacggacttacgactgttcgagcgtttggtaagtcacggtttttttctaccaagtcaactgctcacattgatgtgcgaacaaagatggaattcttgtcatactctcttcagcaatggcttggattgagactcaccacaataggagtagtcattttcctgtccagtggactttctcttgtcgctactttacactggaaacctctttcagccggtttggtcggtctcgtaatgagctacgcgtccaccatctcatcatgtctcagcgaagttgtgaaagcggccatcagtgtggagcaggagtctgtggttcttgaaagaatcttcgagttctgtcaaatcgagccggaagcccctccgaaagcaaaggagcctgctgcccactggcccaatgagggcagaatcacgttctccaactactccaccaagtaccgggccaacttggaccccgtcctcaacgagctctcattcaacatcaaaccccgggaaaaagttggagttgtgggacggactggagccggaaagtcctctctcactatggcactgttccgtatcattgaagcatcaggcggatcaatcaccattgatggagaagaaatatcaaacattggactccaagacctccgttccagactgtcgatcatcccccaagatgctcagatgtttgagggaaccatcaagacaaaccttgacccttcgggcaagttctccgatacagagctgcttcaggttctagaacacgcgtctttgaagaagttcgcagacgacaatgagggcctcgaaaccaagctcagcgacggcggcagcaacttgtctctgggccagaagcagcttatttgtctgggtcgtgcacttctgacaccttcttcgattctggttctggacgaagctacggctgctgttgactatgagacagacaagttgattcaaaagactatccgtcgcgagttcaaggaccgaacaattcttaccatcgcccatcgactcaacactgttatggatagtgatcggattctggttctggatgctggcaacgtggttgagtttgacactccagaagagctactaaagaacaagaattcgctcttttacgccctggtgaatgccaataacggtgacaagctggacacataattgtaatgataataggcgttgattcacagtacacagtatgtagtgtgctaaagagaaggtcatctgtatagacagtatctccaattattaccaactttcgcgacggaaatatatagaagacgggctctaagagttttctcacttccctgcaaacatcaaaaacccacccactgactttagtattgcccatatatagacctacgctagtacccctcaaacacgtttccatgtctcgagtctgtttggtcgtatttagaccgagtatcagggctataaaatgacccaaacgactctcctcagcctgagcgtctcttgtttgtgcctctattgactgacatggccgactttgaagatagcgactacgacgaggagttcgacgaggactactatgaggacttacctgcaaccaggcaacaatgcctagaacagatatctcatctggaagaagacatccaggaaaataataccaataagagaaacctgctgaaagaaatcgaaactcaacccggacctgctaccgaagatcaggacgagctgctatggttcattgaggacgctggaagacggatggatgagcacatggagaatctcaagagacttctgagcaaagatgagtggcagggagagaaagagaaatagtgctttaatgaactcacatattctgttaatattctacgtgtactgaatgtacgcttgctgttcctgtacattacttttacgtcgctgtcagtactgcactcgcactgtctggaaaccacagtattcaactcgtagcagaaactcacaccgtcacaacttgtacaagctatggccattaaatataaacaatacattaaatatacctgtcctaccagagtcttttctactcgtctactccgtcttcggctttttgatctcctccaccttcttttcctcctctccctcagcacctctcttgacgcctcggttctccttgcccttgacaaacgatgcctcatcctgatcatcgtcaagcagccacagtgccacatctcgtgacggcttggagttgacctcctcctcgtgactctggctctggccactcatgaccacattctgcacatgctccttctgtttggctcgatctcgcattcgctcttcgatagtacccttgaccagcagacggtacacagtcacctgccgggtctgtcccagtcgatgggctcgatccatggcctgcgaatcgatcgtagggttccagtcggaatcatagaagatgactgtgtcggcagctgtcaagttgatacccagacctccagctcgagtggatagcaaaaacacgaatagctcgggcttggtctgccagtcgttgacgagatctcttcgatcggacagcttggaggaaccgtccagtcgacagtagttgtactgcttgaacgtgaggtactcctcggccaggtccatcatcttggtcatctggaaatagacgagaacacggtgacctccagccttcaactctgcgagcagctcgtccagcttggcgagcttgccagagcacgagatgaacttggacatagagggcattcgcagagtgttgatgccgttgaagtccagcacccgagacgggaacagatcgttgggaggcagtgaaacagacccaggagtcaatgcagtgacattggtgccctttacctcggcctcggccttctccaaccaccacagttcctggccaagagtgaggggtgtaagggctcttcgcacgtccacgccacccatcttctcctcctgctcaatctggaaccctcggtcacggcaaacaaagtccacaggaggagcaacgacgcgagggtcatatgcaggctccagtcggtggagatacgagtcgtagagagtctcaaagacgtcaaatggagaaggagcaggtgtgtacctgggcagcgcaccgacgctgggaacatcacgattgacctcgttaataacacgctccatgacccccatctgactgactcggctgactcggcccactcctccttcctcctcgaccacaaggtctctctttcgacccatccaagaaggctcccagatgttcagatcgaccttgagcagcttattcaagctaccggccttgctgtgttctccaggaacgtccaagaagcccccctcccggtacacgagcttggggacttcaaaactgatgaggtttcgattgctgcttccaatccaagtgtctttgtcagagccacagttggaagggccaaagttataggcactcttcacatcggcacgctcaaacaagtcgggatggttgcaaacctttcggaattgcatgaccaggttcatcagactctgagtgttctcttcagagccactctgggccttggcaaggagctcctgcaggttgatctgagacttcagaatcttgtacatgactcgctgccgggtggtcaggttgcagtacacatcaatctcaatcttatcgcccagctcttgctgcacgtgcttcttaactcgtcgcaacatgaacggcttcaggatcatatgcagtcgcttgagctgctgctggtctagctgcgacttttccttggcgtgcgactcaatgtccttggaaaaccattcggaaaactcatcgtgcgagtcgaaaagagagggcatgatgaaatgcaacagcgcccatagttcctgcatggagttctgaatgggagtaccggtcaaaagcagtcggtttcggcactggaaagccagcagagacttccatcgcgaagaagaagacgacttgatggcctgagcctcatccagaatcatgtattgccacttcactcgagaaaagtactgggcatcagacacaacgagctgatatgaggtgaccagcacatggaacggcgaatctcgcgtgtacttgacattctttctgtcccagaattttcgcaaaatctttcgatccttaccattaccccaataaggcaacactttgaagtcggggacaaacttggagatttcctgctgccagttgtggagtgtggaagcaggtgcgatcacaagatatggaccccagatgttgtgggtctcggcgagataggccatgacggagatcgactggacagtctttcccagacccatttcgtcagcaagaataccgttgataccctgctcgtacaggttggccagccagttgagacccttaagctggtattccttgagagtgcagttgaggagtttgggctgggagagctgtaggtctccaagagacgtggggttctgaaaggcgtcatccgagtcagctgcagcgccagattctgcggtaggcgtctcagactgcgcgtcgaacgcctgggcctgctgctggttccttcgcacctgattatgagcattctgcatggcaatctgccgcagcttgtcgtcatcgtcttcgtcaaagtccagctctgcagcccgcttcgtctccacatcgctgccacttttggcaatcttctccatggcctcgtagtcctcgtcaccgtccttggcagcctcaccatcttccatctcgtcagtcttgatcttccgaccgatgaaatgtgagtatagctctgtctgggtgagcaagaaattgagcttcctggcttgccgcttactctctcgatcttcctcgtccttcttggcctggtcaagagcctccttctcggccttctttcgcagatctcgctcttccttctcatttctcttccagaaagagagcatctctcgcatagctcgtcgagccttgccttgcatgtccttgatagacttgttggttcgatattgccatcttcgggcctccttggacgccaaaacagctgtttttcggtggttggactgcttcacggcgatcgttgcagccacagttttgtgcaccttggcggcgtctcgacgtgccatatccttccaaatggaatcataggcctgatcaagctgcttggcagcagccgcagcttccttagccgccgcattttcttccctaatctccctgtccttctctcgctgctctgcctggagctgtttcttcgtctttggcttgggggcaggggaagcctccttagaggaggttcccgctgcgacagaagcagcagctgacgtcttagatacggccttgcttcgcttctttgccttcggagtggacacagaagaagttgttgcggcggcagcggcggcagcgcctgcagcagaggaagctgacgctggtgctgacgatgtggaggacactggggctgctgatgatgacgacgatgcagcaggactggccgatgtatgtgcgccggccaggccaccaccctcctcgtactccacaaacgccacacgcacaatcgcctccttttgcagggacgtcttagcgctttgcttaacggctgcgtagcgggctgcgtttgtgtacgccttggttttcgtgtattcatcaatcacgaccttgtctcgcaactcttccagctgcaccacggcctccagccggctctggacctgctgtagaaatcccgtcttggcgtctgcgtatgcgggatcatctgcatccgcgggtggtgactccggtgcagagtgatcgccgtcaacagacgtgtgaccctgaatgggaatctggataggccacggagcctgctgcggaatctgctgctgcgacatgtaaatgcggggagcgtacatgtcaggtggtgccggatgaccctgatggccagggtgtcctgggtggccctggtggccgggatgaggaccctgatgctgcaccgggtgaggagacatattgggatgaccctggggggacatgtgacccggatgcggtggtggggggtgttgatgctggggatggggctgctgtttgtggtacatgggcggcgatgtggaagagtggtgctggtgctgcagcatgggaggtgagtgctgcggcgagtggtgtggatgcggatgatgctggtgatgctgcggcagcatcggtggcgactgctgttgaggatgctgaggatgctgggggtgctgctgctgcatgtagtgctgctcgtggcccatcatgggaggccccggcatggtgtgtccattctgaggcgaatgctgtggcgagatgtgcggtgcctgatgcgtctggtggggggagagatgtggtggtggtggtggatggtgcagagcaggagggggctgttgctgtagtggtgactgctgttgtagcggtggggccggtggctgctgagaggcatccgatgcacgtcgttctccaccagagagaatcgatgaaatggacatagccccgcggttctgtgttagttagatcggtatcgtagagatggcatgcgacatggttgatgagaagtgagacatggtaaacgggataggggagctgtgatagggcaggaccggagatggagatactaacgtgtcggatccagcctcaggatgcttgatggagatgtatacggcgatgacagcctcgtcagcaaagagatcaccgtttccatatcactttctatcacaggcggcacgaacggtatccccatcgaccgtggcagaagcatgatcgagacacttcacggatgcagaatcccttcaatgccatcggcttctcatcttcgcggccccgttcaggtcttgtggcatgtcaccgtggtgctacccggttgacataagcagcggtgtgggtgtgtggcaatggcaacaagacagaatcgaaaccgatcggctcgccaagggcaccatcgtgctcgccgagtcccaccaagttgattgcatcttctcccgtcgcccacaaacgtctgtggcaaaaaataccatgtctccctccctcgccccaaacctccctcctcgtaagcccgtattcagccatcgccaactggtaatactcacggtctcatcgtggttgttgttatggccattcatggctgttttcgttgcttgtctttttgtgtctgtcgttccgcgtctttgtgtcgtggcttggtggtgatggatggagtcaacaataaattgtgcagtgctgttgcgttggtctcttcctgcctccaatcgaactcgagcgcagcgagagttcgaagaaaaaaacctgcccgctgtttctggaggtgcaccgcaacgagaagaggagtggggtgggaaaatgggaaaaatatgggggaaaggggaggaggtgaaaagggccaggttgatgattaccaaaaaaaaacttggtatttataaaaaccccccttcatttgtcaaataccactccgccccatctgcaccctcccttcttcctcagggttcccaatagtctatctatcgtatgcacctgtgctccaccttccgggggtgtagcagaaaaagccggatacagctcacacaataaggggcaaaatcgagcgggcatggaacaagatggggatatttgtgatgactaatccgactttttagaatatcccacagccatccatctgcaccctctcttcgcgccttcttccactttcccaatcgcatgcttcatgcgctcgactttgacgtaatactatgtaatgaagtagctctgggtgaaggtggaagtctccgagaaatggtgggataaacgtatggaaatgctggctgtaaagatctttctgtggttgtaattgataccgttttactttttcttgctacaattcaactttgcggtggctcttccgccctacaagtacctggtcatcaccgcaatgtcgagctcaggacggaagacgtctaactctctcgatacttgatatatggagacgggggtgcagtcaatgtgctcggctcgtcgcaaggaagctgttggtgccactttcggcgcaagtaggcccacattagccaaccccttgacagccgaccgggttagtttttagctcacgttatttccacgcgttgggtgcaaccctcaaacgttttcgctgcattattcgaaaaccatcgtgatgattgatttacggataccggcctggattaataataattgacggcgacgagctatgatgattattaggtagttaggaaatgaaaagcggaaaaagacgtgcgagggaagcggtataaatagtaggcggttgccggcgagcaaacccattaacaaccgggtctaaaccctgcctctgtcatgttcaacaagatggtcctgtatatatactggcttgcccctcattcagcccagtccacacgttccgttgctgccaaagtgaaactttatgacgagatgttggtgccacttggaggtggtttagttgattaggagcaattttcgaaacccaaatgagactgcaaaatcacgtgttttccaactatcggcatttcgactcattttgatgaatgaaaacacactccatcgtactccatcgcgagcacttctcacaaccactcgccacgatgtacagtaacaacgatgttggtgcaaacaaggttggcgaggacttgggttgggttgggacgactacagttctgggttggggttgaaatacgacataataactgctgaagagggcacagcccaacaggtgaaacagccaatggaagtacgcgatgattatccgaacgtgggaaataacttcaaagacgatccgaggttggtaaaatgtcgttggagggtttttcaaaggcctttggaaggtttttccaagggtcttatgccattcgaaggtcggctgagagacaactacgatagagtgaccttgaagctatattgtagttgaactcagccgtagtgtttgttataatataacaacctttagttgagtatacaagaaccccacgagagtactccattgtcgagggtacaatcatattaaacacccaaaagccgttataaaacactcgagaaatcacataaacactctagaactctcatttccaaccaagtattgtacaaaacgcctaatatcaccatggaatacaaccgtccaaatctcagccttacacgttgcacttacatctgataactttagtatagacgcccaaagtcggtcaatacgaacaacaaacaagacaaacgttgggcccgatgcataaaaggggtcacgtgatccaccagagcccgccaccccccctcctctccagtatttacctcatgcgccaggtattgctcgcttactaagcgttgataaagttcacatctatctgcaccctcctcctcagttcaccagttattgtaacaagagacgttgcaattggagcgacacaaacggaacggggaaaaggtatcacgtgaccgtattactgacatcatatccacacggcgacaaccctaactcctgcggctttcgactcgcaaattacacgaatctacagtacccagtgtcaccattgcgagggtacatgaccaggtgacaacaaaaagaggtctttcgataaaacagcaacttttgggggcacattccgaaagattggatcacgtgacctactaaaactacattgtgagtgacggcaagataatggagagactctccaccctacaatatgtctagacggattaccactgtctagaaagagatgactggttatggctaatatcattcaatttgggagcttgtggagatgatgttactttttgaagttcttcaataacttcatttttgagcgatgtgtgatatttctgggttttgttcatgtttgaaacctctacatgtggccaagcagtttgtttacgttatcgcgtcaatttttcttcgcatatgaatgttcctgaagccattcttctattgcgactaacccagctctgatctatatcagtacaagtacatacgtgatatatcacgagacacatcttctgcagaacgcacgttcctcccattaatttcttctacaatggtcaccactccgcgtgactcgtttgattctctgatatcagaaaacagcaatcctcagatcacagaacccgaacccccatcttcacccagaaacgtcttcaggccattcacagacacaatcaacagagcacaagcccttgcctctgctgctcttacagacgactctgaattcacatacaaccacaacatcttctacgatgacaaaactactattgattggatgcacgagtttgcaaaagaacgtcagcagcgaagaatagcctgggatacacctggagttcgaggccaggcgctacgattagtcaacactagtcgccgatggattatcttgattggtacaggtattgcggttggtttgattgctgcgtgtatcgacatcactagtcattggatcgcggatgtaagattgggctattgccagaacgctttctacttgtcacgtgactcctgctgttctggtattgcaacaaacgacccttgccccggttggattgagtggagctcgtcgtattttctgcggtacatgatgtacactttcatctgtgtcatttgtgcaacttctgcgtctgtgttggtcatcacatactctccacactcaaagctgtctggtatttcggaaatcaagacaattctggcagggtacattatcaagggcttcatgggcaagtggactttactaatcaagtctctcggactggggctagctgttggatctggtgtttgggttggaaaagagggtcccttggtacacgtggcctgctgttgtgcgaacctgctcattagatacacgtcacgtgagcataacgaggcccagaagcgtgagattctgtcagcagcggccgcagcgggtatttctgttgctttcggatctcccattggaggtgttctcttctccctagagcaagtatcgtactacttccctgacaagaccatgtggcacagttttgtgtgcgcaatgattgccgctgtgactctgcagttcgtgaacccttttagaacaggtaagcttgtgctgttccaagtcgagtacgatcggctctggcaccgattcgagcttgtgcccttcgccattctgggtatttttggaggtctctacggagcttacttcatcaagcttaacctcaaatatgctaaaatgcgcaagaccaccttcatcaaaaactttcccattctggaagttgccattctggctctcatcacaggtctcatcaactaccccaatgtctacatgcgactccagccctctgttcttctgtcctatctcttccaggaatgcaacgcttctactccagaagctctttgtaaccttgacaactggtctcagtcggtggcgcttctactgtcagcttgtggcctaggcttccttcttgcttcttattcttttggagtggcgctacctgctggaatcatcatccccagtatgtgtattggggctctctttggtcgtgcagtcggtattctcatggctacatggcatgaaacaaatcgcgactttttcctctttgccagctgtccggctgaaggtacatgtgtcactcctggtgtgtatgccgttgttggtgccgcctctgctctgggaggtgttacaagacttactatcagtattgttgtcatcaccttcgagctcactggagctctaaactacgtgcttcccattatggctggtgtaatggtcagtaaatgggttggagacgccattggaggtaagaggggtatctacgaaagctggatccatgtgctgaatttaccatatctcgacaacaaggacgacgaacctgttcctgttgtctatgtgaaggagtttatgaccagcattgatgatcttgtggttattcagaccaactcgagtgaccacgtcaacacaatcgactctctccaatcgactatttcatcttgcaccttccagggcttccccatcgtaaaccaagatactattcttcaggggtacattttccgatcagagctgaagttcagtatcgataaagctcttttgtttgatcacctcactggtgagacagagtgcgtatttgaatctcgggatgctgaagactcttcatgtcttcttcttcgtgagtgggttgttcaagctcctcccacagtcacttcttcagctactctccagctagtgtctaacatgttcttcaagctgggtctgcggtacatttgtgtggttgacaagggaaagttggttggattgatcaccaaggaagatttgtggcgactgttcaattcggatcgactgaagaccatggccgtcccgattctgggaactgttaatgatgagagtaggcagggactgttgcatgatgacgtttaaagcatgcatgctagtcgccgaagttctcgaacgggctaccactcgtgttgccacgatattactagactgtgacatgaaccaattgactgaccatagatacaggtctcagagacaggttactcacacaatcgaatgaaacacgtagtaatagacaaaaaaaaaaaaaaaaaaaaaaaaaaacatccaatcgtgtgcgtgtaagttacagttctctgtcaattggtcaggtaggcactctttgcgtctatactattcattagaatgattattactatgtacattacctgaggtctatgcttttatacctatctgatgcgtcccatcgtcatttcttccacttcaacggcttgttccactctcgctcgcattgctgcagaaactcgaccatgttgaaactagtttgagatctcagtctgtggtaactaggaggagtggaaatgtagagcttggtagcaacatgttggatggcgtcagcgacaacataggatcgaatatatgacttggagtttttccgaagcatgttgaggatgcgtacacccgaccctggatctttggggctcttgatggcaccccacttgattgtttcaaattgaaaatagggtgaagagaagacttggttgtatgaagggggctgcactgggttggctgaagggaaatctgagctctcaagcacaccagagtcgttagaaaaaccagagttgggctctttgataagaggttcggacgcagataaaggctccatctctgaagcaaacgcggactcttcttcttcgaccagaccttttcctgtcttgctaatccggtcattgatccgctccacaatagcttcactctgctgaacaatatcggcaaactccttgtcgaagtctagagagatgtatcgatcacgtgaaaaaagtctcgccaacccccgcagaaacacctctacctccggttgagtcagcgcacagatttgcatcatttccagattgtactggtaccaagccatagatgcatagagaccacgcttatgtagttcgttcaggtacctcagagtcacgtgaacgggcagtcgagttgtaggctcttcacgtgtttcattgaacttgctgatataattagcaaaccgttccacgtgcagatgataacgcaagccctcagtcatcaagccggagacatcagaggttgttttcttggggaaaatagacagtcggcctcggtacaaagctgcagacagaaactcgccagcagtaatgtgattagatgtctccgtatcccgggccattatttctgccaggtagagagctcctctgaagtctccatttttgagcagtctttggaacgcctgaatgtaaaactctctggtcatttgatcacgggcctttagaaccttgatcatgctcatgatagcacgagaattccttgttctgcaccagtgactgaaaaaggtcgtatgtaatgaaatgtaggagccgtactgcttatgcaagtcatcgatgacatctagcgcgtctgctggatccatatcacgagtaaagagtcgcaccaaatgctgtccgatctcctcggtcgccgaaaagccttcatttaacatagcttcgactaaagcattggcatgagccagttcgttggtcatcaaagtcgcttctatccaaatggcttgtgatgggggcagtttccggatcttcgttcgcaattgtttgattgtaggagcctttcctcgggaaattacgtttccccagaagttggcagataggcctcttagcaaccgctcgtgactaatgtaccactcaagtggttcgttgtgagatagatggaggtagatcttctcccacagatggtgttgcttctcgacgtaggaagaagagaggagtgaggtggagaatatcatcacgtaggcagatactaagtgggtcagatcggggctggtttccagaagatgcagcaagtcgtttggacggtcgtagaagaacccctttagttgcgaagacagcttcatgtgaccaagcttgcggattttgtttttgtctcccccctcattcttgttcgttgaaaccaagtcctccacagacgttgcgtgtccctgttccttgcctaacttcaccgccgtgctgagaaagaagggtaaaatgttcttcctcgtatccaccaatgagttttgcttcattagatatctgaacaatggcagttgtttgcctccacagatctcaatacacgcctgttgaagaatctcaaacaggtctttctctgtatgcgctcgttcgataaggtaatggagggtgatctgagctccttgataggcttgtgatgcgattagttgaagaagacatgacagaaggatatctggtggttgggtaatgcaaaagtgttccacgtgatctcttaacttagatggggaggctgagtcaatgtcgatcaggtcagaagatgctagttgttgagatgaggtaagaggagctgtattcagcaactgctgaagggctgttggaagtgccgagtcagccgggcgagatgatgagtccaccacagagggattagaatcactgataaacgaatcctggaaacttttgttttggactgtagattcttggttattcaaaatctcactcatggtgctgacgtccccgcgacgagccttcttcgtcttggtcttggtcttgatagcattctttccaccactcgtcttctgaacaagcttgttcaccacatgattgaaatcctccactgtcgtcagagtaggaagctcaactgctttggaacgctttccccctgtatgcaaaaaatttgaaaagttcagtggcaaagccatagacatattgggagccacatgacggtaccggcaatcacgtgacactccaggccgtatgcgtttaattacgcgaatacctcggatcatgacacgatcacaatgtcgaaaatatatgtcgattttagttgtggtatgagtcctagtaatatttgatgcagaaatgataaggttgtgcatgagacgtgcatgcagaggcaaggcacgtgatgaagagggacttgagagactgaatgtcacatgttgtcacgtgatccttgtctgagtactatatcctatagtacgagtaagatacttgtgcagtactgtacctccatcctgtgatcattgcacttctgcattatccatatttttccgatggtttcagaatgtaagtcacgtgatatgtcatgtgatcagtcggggctattgttttttttgtgggggccttcacctcgcgtgagacttgtgagggacatgcatgatagaggcatgattataaaacgcggaaattggatgagcttggtaactgaccgatgggtcacgtgatcaaagtccaaaccactcccgtgagataataaacacgagtctaaactaatccgattgttccggttgtatttggtgtcataaccatcatttcagcaactcctcttctgactaacccggatgtgccatagcaacagcattggtctgtttgggaaaagaagaaatataccatgcaatgcaacgccacgcgaagaacatgctgatatgtcgcttaaccgttttttccggaattttcgcgcagttacagcttgaacggttttttgaaaatcttgaaccttttccgtaccaaccattatataagctgtagatcgttcagacaatgtaaatcgaatctccaggaaaatatctccacaatgataccctatatatgcctgtttggagccttgcttccccacattccgtagtcttaagtatttcgaggcttggaagtatttagtgaaagttagttgtgggaccaggatgtctgtggaatgctcaacaatggtttcatcacctccaaattctttctggatactcccaaagtttggtttagtaggttcaagttctcagttgctttctaggatcgttctcaaagtgacagtacggatatctgatacattcttgaactgcgacatttacggcactatacagcaaggcagtagtctgatttggtcaatatacactccaggcgattgaaaaaggtgtcataagaatcgccgtggcaaatttaccaagatattcccataatattctcgatcacgtgacttcctagccgtcaagcaaaaaccggagtttacggacttactctcttcccaattatagcgtccccttagtttaaccttagtggcgattttcttcccttcaccagacattcacacacctgttcccaggcaccttgaacgagctacacaacagggctgatcgcgtgtaactaacgacagcgcaaccactgaccgcgaagctgatcacgtcatccacggccaatcttttagggcagttttaagccacgacacaccacaagaagctacacaaagtgactcaagcggcacttacgcactcgaaaagtgctatagagcgatacattctgcacttatacgtgattcatctactcactgacaagatattagcgactcccccatctctttccgacaagttttgacctgtttggattgattcaacagcaagcgaaacagaacgatacacccaaaagacacacaagtacattacaggtcacgtggcgggtataactagttacagcacgtgattcaacccattttcttcacgtggaaccggaacgagtcattagctgttctgaccacatacacaccggcttgatcggcttaaagataacactcttcatatcccattcattcacgtgactttagtcattcacgtgacacactacacacgactctaagcgactacctaatcatgcgacattccatcgacacacctgcagacgactattccgattcggagttgctttcggactccaacatggatatggatgccgacgagctggacgcagagattctcgatggtcttggaaacggcaagaagcttggcatgagcaagcccaagaaccagaagaaggcgaaaaagtcagtaaagatagaagtgccagctgcatcggacgaatcacctgcatacgacgagtccagtccctatggcggacagggcctggactatgagggaggagaccagtcacgagatgcatcaggagagaacctcacgtcgtcacaagaccagccgaagacggtgcactggcccgaggaggacattgacgagaattatcccgacgccattcctctcaaggaggtcaagaaacccaagaaaaatactctcaaaagtatcatcaaaaagggcaagtccaaattcggaggtaactcatccgaagactcttcttcatactctcttctgggtggaggacgacgatcctcactttctggaggacgttctggtcgttacaacaaggtcaacttcaaccggttcgctacagactcctcagatgaagactccgacgccgattcggactttggacagatctctattgacgtggagaatcgccccagacgaaaggtgcgtcatcagaatacgaagacgctcaacctgctgttgtttgcgcttctgatcattgcagtgtacttcattctgacactcacctttggtggaaacacgggtcccaagggcagaccaagcacgtacaagtcgcgtgaaaaaattctgctaaataatggaacccatgacttccatccgactactctggttatcagtttggatggattccatccccattacatttcgccagagctcactcctcatctggataatctcatgcgaaaggagagcggtgctccctacatgctgccttctttccccacttcgacgttccctaaccactggacactcatcactggcttgtatccttcttctcatggaattgttggcaacacgtttttcgaccccgatctgaacaagcagtttgtgaacacggaccccagtaggtcgcgtgacgttgcgttctggggtggcgaacccatctggcagacactttcctaccagaatgtttccactgccgtccacatgtggcctggaagtgaagccaactggcttcctgaggatgctccattaattgttgaccccttcaaccagacagaagctttgtacaagaagcttgatcgacttacggagtggttggatcgacctatccaaaccagaccggaactcatgctcacttatgttcctacagttgatactcttggtcatgttcatggcatttctgggtctgaattggagcaaggcattcatgaggttgacttgttggtgggagctttccgagaggctcttgacaaccgaaacctcactgatgttgtcaacctggttgttctgtcggatcacggtatggcccctacctctgatgagcggctcatctttttggacgatctcattgacgtgggtcagattgatcaccttgacggctggccactggttggtcttcggcctggtaacaacatgactgagtcggagttgtttaacattctcaagaagcaggagcccgagaacgagtcttggaaagtttacactcgaaagaaccttcctgctcgatggaactttggtggaaagactgggggacggtaccagaaccgtcttgctcctgtttggattattcccaagactggctggagtattcttactcatgatgattacgccaaaatggacaactcataccaaccccatggcacacatggatatgacaaccgggacattttgatgcgtgctctcttcctgggatccggcccctacttccctgatttcaagtttgagcctttctccaatgtgaacgtgtactccattctgtgcgatactctgcatgtgtatccttccaagaacgatgctcagcctctgactaaggccttggttcggcttaatgacgactggcaggacgacagtgatctgtaccccggtgtggacttttccacttctgtcgtggagggttctacctacgatgagttgtacagaactgagggacatgccaacggcagtgtccccaccaatggccaggagcccagcagtcagaagggaggaaagaagcagagctgggctgattatctgaagggccagacaaacgaggccatcgactggcttgccgacaaatgggcaggtattgtcggacatgactagtgggcgtgctcgggtatatagtgacaataacatgtatttatgacaccattatggtgagccaatggttgtttgtagggtccatctcactcgtccacttgttggccgctgctgcgaggatctagtggagatatatcactatgcgtgataacaaaccttgcagtggagtgcatatttgaggtggtatgatgatctgacgagggatttaactgggtatctgtctaacaggtcctgctgatggtttttcatttgtaaagctattcactgttcatctcggggctgagttcttggttttccccagttaactaactggtctctcagcatttcgttcctcaaagttaagcttgatccagctagcgcgccattaagagagatatatataccggagaagtctgcaagtggctcggacttagactgttcctgtgctgcaacatggagggcgacaaaaacaagtacattggcctggcgctggccatgtcgtcttcattggcgataggaacctccttcatcatcaccaaaaaaggactgatggcttcctcggcacactcttccgatccgagcgactcctacgcctacctgagaaccccggtatggtgggctggtatcatcactatggctgtgggtgagattgccaattttgcagcatacacatttgcccctgccgttctcgtcacgccgctaggagcgctttcggtgatcattggagctgttctggcgtccttcttcctcaacgagaggctcggttttcttggatctgtgggctgtgctatttgcttggttggatctctgatgatcgtactccatgcaccagccgataaagacgtacagactgtggacgagattctcaattacgcggttcaaccggggtttctggtctacgtgtgtatggtggcaatatttgcagtcttcatgatctaccgagtagcgccacggctgggaagaaccaacccgatgatctacatctcaatctgctcgtctgtgggctccatatctgttatgagcatcaaggcctttggaatcgccctcaagctgtctctagaaggaaacaaccagttcacacacccctcgacatacctgtttctattggtagtggccatctgcatcgtcacccagatgaattacttcaacaaggctctcgatcagtttgacactaacatcgttaacccgctctattacgtcacattcaccacatgcactctagcagcttcgttcattctcttccagggcttcaatacaagttcacgagttgattcattctggttaatagcaggttttctcatcatatttgcaggtgtttatctcttgaacgtgtctaaacaaaacaatattacatcgtcgcaagaccagagatctactgatgaggagtcggtggcaatgacactattgaaccatcaagatgaagatgatggatttgatgttgacgatgacgatactgaaattctgagaaactattaggttcttcaaattactcacttgttgtcattatacattaatctattactgtcgtcactatcatatggtgtccagacaccacccgctaagcccacgacttaacgtcttctgtcgaactcccgtttcaacagcacctgcaggttcttcacactcaacactagacactgcagatcaatctcgtctacttcctggtccgcaatctccagcagatcgtcaatcttgaaatcaacagtcaccacgggatcacttcggcccttcatcaccagagcgagaacaaaagttcccggtgctggggaagcaatgtaaaacaccagagaggggccaacccggttaagaggcagggaacaggtcagaatgacaccatctcgcatcaactgcgtgacgttgtacttcttgaccagtccctcggagtacgaggaagtgcttcctgcggggttcagaagaggattgggtgtcgtggcggtcgtagtatcgtcctgcacaatctttctgtccttctttgaaccagtgtgggatcgcacgttgttgaggtacgacctgtatgtgtctagctggcttcgaaggtactcgttctgctcagtgatcactcggtagacagtctccagagaaacggcctcctgctccacagaatcctgcagtgagcccagctggctcagttcgttttcaatttcagaaacaagcacaaatttgtcgtcatctgcgtactcgtccttgtccatctcatcgagcaaatccagcgccttaatacctcgcttaatgacaccagaatcatccacggaactcgaagcagcaaagtcagcaatgcttctgagtcgtagaggacgtgtgagaatgggatgaccgggggggaaggctcgaatgatgttaatgagaatggttttgagctccatgaagaccacatcagacctggaaatgtcaggaagcaaactgagaccattgtatgccccagaatcagaatgagactcgttcagaacagaagcttcccactgagaaaagagagagaggtcaatggtagcattctgggctcgaggaacaagagcgggacaggttccaagatctcccataaccttttgaagatgaacatccttagtatctgaaatatacttgaccagcaacccgtgcatgccgtagatttcgttcagagtgatggaaatagacagatctttcttcgataacgcaatgtactgatccatctcgagagactcgtagaagtcgggcacctcacacagctcgttgagaaacttgttgactctgttcttgttcacctccagaaatggcgtcaacgatgccatatagggctcctttgaagtagtgggtttgtttgcaatgttctgaagaaccttggccaccagtgtgagggttcttcgacagttagcatcattgggcagtttgtctatcaacatgtaagtctgaggagagacaatggcaggattgatgaatctgaggaagaagaaagctccaatgagcgagcagactgaagcatcgggagcatcggggtactttcttcgtgccagacctcgaatctgtttacagatccatcgaataccgtaaggaacgatgctcttggagttgatgatcgtcgaaagaacgttctcacagatagcttcgagcgtcctgagacgtggctcaatgattgcaatgacctcggggttctcagcagcctgatccatcgtcatatctggagcagagtccgtctctatgagcactctcattgggttgatttcgagagtctggggattagaaatgatgtcattgaggcaatgagacagtgtttctctcaggtacgactgaccaggacctcgtctagtgtaggtagtcatcattctggaaacaggagtgttggctcttagtaaggacgagaactccagagtggtatcaaattggtaggccagcacagcttggaacatggatagcagcaggtgctcttctcgctgttcgtactggtttccgtagatggtgaacatgacggtttgcagaagagaatcaatctcagtcatactgaccagagtacacagagatgcaatatgtttgggttctgattgcagcagaaagaagagattcgagtatagatccgtcttttttctgtcggggaaactcgtttcgctgatagcttcgtgttcgtccagacgagacgcaatgtctttctgctcctccacacccatcttgttctgaatgatgagtgcgattcgggtatccagataccgcacgtccttctctagcacgaaattatgcttggactgttcagaaatcgcagcctttaggaacctcaggtgtttctgagccttggcaagcgcatcatcgatgtcgtcgtccttgtcgactccacccatggacatgtacattgccgcgacggagaatcgcttcgattgccgttgcgagggagccgtggacgtccccgtttgttgtcgttgcaggggtagcatggtgactgtctgtggtgtggttgcggggatctgtcggtgtagaaggttaggattgccgtacttcaagcttgtctagcttcagcttgccgtggagattctcgtagatgtcttcgaaacccaacaggaatggtttctggaactgactcaaaaaatcgttgtagaagtggattttgtctatcgtagattgccgtggcaattggtgatgggtcgcttacttgaataatgtcgatgcaagttattcaaacacactcaaaatcaatcacaatgcttctgtgttagtagaactgagtactaccgtgtggaatctcgcgtgagaggcgtttagtggggatggtggggttgtctgcgtttgaaccgaggtgcatggtgacccatcaaagtgtgaacacaagatgagaatgatgacatgatcgatggtgagggggggaaggggctttgggatgccataaaggagaatgtttgtgtaacgttgtatcacatattcttctgtttgtgaaacccatggtctgtctgtctctcttctctcttctgttgcgtcttccaaaatcacacccttcaaccacccttgcgaaggacctggttcaaccgcgtctcaaacagcgtttttcttgtcactggacccgtcacatgatatttccttgaccgaatacactcacgtttctccgaatccgtttgtgaaatcgaagttgggcgattccgttcaaatccgtctctgtcgcgtgaagatgatttcacggagtcacgtcgtttccagagttaccaactctagtgggtttaactcaaccttcgtgatcgaacctaaacctccagcttccaaattgggatgtgtaagtaagtatgagggtagcggtggatgatacgagttcaggtagagtgccgaggtgaaaaagaggtgtctgtgtggaagattgacgttactgtctgtgtgcctggaccctctacagcccccatcactcataactccgttcataacctctcacttatgactgcctttctacccctattctcctctgacataattacccttccgtcgtccctatccttggttggtacagtagctctctcacagtgtacgagcgagtacgtacggtacgatagatacatacagtaatagtgtgccacacaacccgcatcctagtcgcaaacactatcttgttagcagcagccaacccctttaatcacgtgatgcagatctaaaagcggccagccccagatctggaccaatgcgctgttttggcggtgaaaagtcggcggatttggaattgggaaagacggaaatgctgagaacgtgcgggagaacccattacgcaagtgcccttacttgtacttgtacatccccggtaccttgtaacattcctttgaccactccccacaatgccagattaagttgcgacaaagagagccataatatgtcgtttaatgtggactaacatggtctaatatggtctaaatatgatctaatatggtggaataacaagatacagggggtggggtggatgatgacttcttgtcggcggtgcatactagtccacattgacattttctcttagggctggtagttgtgctcggggctactggtcagtcttgactgcgccaatatcccccaaaccgtcgcgtgaattttccttttattatactcgtaaacgcactctactcctgacacaacggcacatctacccctatacgatcgacagagtttatctataacaaaatgtgaaacgcgccggcggagggagtggagtggagtggaaggaggtgtcacgtggacgaatattagttggtgggtgaaatatgttacgagtatcgttctcttatttgtacgggagttcggcctagtgattcacgatgcacgtgttgtactagtggtgataaccggaccgccgctaactaaagagacatgttctgatcaacattgacagggctgaagatctgcgatttttgataccaaaaaacttgattctggctttgacgatgaaatgtgaaacactaagaggaggtgatatgaagacctggctgaagctgaccctgtcggattcgaggacgctgtctgaagtgtttgagagtaaacatggtgtgatacgcacagtgaatgtttgacttgaggtgcggaaactactggtgtatctaatggggtggatcaataagtttgtgtagaacgtactacacacaatttgaaggagaaagtccttgtgtccatatcattactggcacaacatcttcaaataaatgatcatatcctagacgagtcgtttaccgagtcgcctcgtcaagtcaagccactacttatagctataccacgtcagtcgagacacccgttctctgtcaattgaaccattattcagtcaattgaaccattattcagtcaatttaaccgttattcagtcaattgaaccatttcttgtatcaagagatcccctgaactcctatgaatgaaaaaaaaaaaaaaaaaaaaaaaaaccccgagacaaaaaataccaacaaaaaccgcactgaagttagcggccggagaacaccctcgaaactgaaacatcggtagataacatgttgattgttagcccgattagttactccaattggtcacttatattctgtctctatgtctcgtaagtcccataatcatgtcagttactggctcagtctactcgtacttatcagtaacaccacactcacaccaataacctaaatctagaacatatctcttcagccgcaccatagtggtccttccattaccaatcacgtggccaacctgttgttcatcatcccatatctattacccaagtcacgtgaaaagtcacgttttctctacccgaactcaaattctcgcattgtccactttttctcaccgaaaaccacgtgggcaagccacattgcgcccaaactgtcagacacgatgatgatctccatatgtcggtcacatcggtgtgccacgtgatcgcacgtgaaatcacacgccaccgtacaaatcgtatgagcgtcaagttgactatctcacatatatgtgacaagacagcgctttggtttaagagatttagatcgatgttatgtacagtaaagtagcattgaaaatcgtaacattgtattgtaaaataagcacgtccttgtttatggagagtcttaacgacacactctaagtcggcgaataatgcttgaattttgtttctgccaagatatattgagtctccagatttagaggaatcgaacaatgcccctaaatttccatttatcccttcgtaggacccagtttatgcatcgtgaaaaattcatctaggttcaactaaaatttacatgatccatgtatgtcacttttatgtatatatgtgcgtgggctgtattggaaagttccagcacatgccccaaccacgagatttggtggatgtttccgccagtttggagagtatatcatcataactgaatcacgtgattcatgtggagttggttatttccactgggttacttgtctctgaatttggagcgtttcaatgtgtccatcttctttatcatagttcaatagccgttaaccgaccatgaatgtggaaatacagcagtatcgagtctacaggatgagtacttaaataagatgcatttcggtagattcaatgaatttgcaaggattcgatgactccaatgataccattcacagccaaaacgcagtagctttgatccacatagaactcgtcaacattgcaaatatatacttagaagacaaatacggaggttcaattatgacattcaatatatcattcgaatcgtcgtgatctcctctttcatttgagaaatatttcatatcaattacaacaaatctggatgagatgcatagatacttacacattttgatctagccaccaactgaggcattctaagaactccaaaaaagtcccaaatcattactcggtgctatatataccaatcccaaagcccttcccgataaaatctaccccaacaccccctccataacatccccaataagttctcctcccaccaatgtgctctataacaaccggcgatttaaactctaaaaacatggtaaccttttttctacacctgtcccaagccacttttcttcctccaccacaccctcatatctttacaacatacacaatgactccccctcccgtggcccagaccgtgctcgaacacattggcgacacgcccatggttgagctccaaaagatcccccagtctctgggcatcaagtgccgaattctcggaaagtgcgagtacttcaacgctggtggatccgtcaaggaccgaattgccaagcgaatggtgcttgaggccgagaagcagggccgaatcaagcccgacgccggctacactctgattgagcccacgtctggtaataccggtattggacttgctcttgtcggcgccgtccgaggttacagaaccatcatcactctgcccgagaagatgtccaacgagaaggtgtctgtgctcaaggctctgggagccgagattgtgagaacacccactgaggccgcctgggacgcccccgagtcccacattggagttgcccgacgtctggagcaggagatccccaaggctgtcattctcgatcagtacggaaacgaggccaaccccgacgctcacctctacggcactggtgccgagatctgggagcagactgagggtaaggtgacccatctcgtcgctggcgccggaaccggaggaaccatcaccggtattgccaaggctctcaaggccaagaacaaggacgtggttgttgtggctgctgaccccaagggctccattctggccgtccccgagtctctcaacgactccaacgagggctacaaggtcgagggtatcggttacgacttcgtgcccgacgttctggaccgagacgtgatcaactcgtggatcaagaccgaggacagagagtccttcctgctgtctcgacgactcatcaaggaggagggtctgcttgtgggtggatcttctggctcggctctggctgccgctcttcaggtcgccaaggacctcaccgagaacgacactgtggttgtcgtcttccctgattctgtgcgatcttacatcaccaagttcattgatgacgactggatgaagaacaacggcttcgtagacgatgccaccctcgccgagcaggccaagcgaaagcagcagtacaagggcgctaccattgccgatctgcatctcaagcccgttgtcaccgtaaagggtgactccactgtggctactgctgtcgagctcatgcgagagaagggctttgatcagatccccgtttccagcaagtcctccggcaagctcattggccttgttactcttggtaacctgctctcttacctttctcacggccgagctacccccgagactcccgttgagaaggtcatgcttgacttccgaaagctcgactctcaccagctcaccgccgatgccattgcttctgccaccgccagcctttccattggcactccttctggcgataagaaggcctctaagcagcgacagtttgtggaggttactgttgacactcctctgtctgctctcaacaagttcttcgagcacaactccagtgttattgtcaccgagaaggactccgatggtgtcaagcccgtgcacattgttaccaaggtcgatctgctcgcttacctcgtcaagaatggttcttttgagtaagaccaccgattaagggtcaagggttatgagtctggggtatcatcatacgcctggaatagatagtttcgtggcggactgtctcaaggaggaacagccactttcaacaccttgtaattagttcaacactttgtgtataggataagttattttatgaagcatgaacgcatctaatcacatgaacaagcaagtgttgcctggcgaagtgtagatgaaagcaaagtaatgggttacagtgtgagcatatcagatgcagcgtctgttttgcagcgatacttgtgacgccaccgtactgtactggaaccagtacgagtactactgacatactgctgtataactccttgagtcttctcaaagacgtatgctcaactatctgtacaaagggtcattccttaaccaactaaacccaaactaaaggatcaactatatttgtatctcaatcgtaacagatccagcgataacgtgagtattactgtgtcagttcaagcgtgtttcttgaatctgtttaaaagttatgtatttgatatccgcctgtatattttacctgatgatggctctctccaatcattgaaagagcacccccagcccaatactacttcaactataatttcaattttcccaattacagtaattggacatccgaagagggtttcatggcggagactaccagtagaacaaacatctgtgagtgttctaattcgttgtaattcttggatacagtattataacatggattccgttactagcgtattaggaactcgagctatatgctcctagaacgcacgtattctcttgtattggtctctcaacggctttccatcggaggatcaactcgtagttggatcaactaggacagttaagaaggattctttgtacagtaattggcagagaccattaccatgaggtttttcgatcaattacgtctatgctgtctcgtatggtggccctggacgtctgctggactcttctgaaccccttaaatgttgcccattggcatggtggtgctgttgaatttcaccaggtaggcgaatatattgaagcgcaacaatcacagcaagagatatttccgacaattctgtgatttatgactccctcctcttcagacaacttccaaccgaccccctccccccttggtcactatgatagtacgagtacaacatcctcaccgcgtacagtgccccacgtaaatcagtcatatttcgttttctaaatacactggacagtacatggagaggtccgggcactcagtcaatcaataaacaagagtaccccaatcctcctgatagtatcaatccacaaatttgtctgtcatcagactgaggagcactggacatgcgtctcgagcgatgaaccttggctttactcaagttcctcgcattatttcataccaagagcagcaaccaaagacttgatgtcgtccttggtcacctcaatctgctcttgctcaagcacagcattgagtccctccagtcgcttgccaacctccttatcggaaatcatcttcatcatggtcatgagaccagaagctcgagtaccgtcgggattcacgtagcccttctccagcatgaagtcctggaatccggcaatctcgtggagcactcggtcgttgtttcggatcttctggatgaactcggactgctccagagtgttcatgagctcgggctcgggcttcttctgctcgttgaaccgggccagagaggtggaaaagggccggactgcgggccgggccacggcaagacggaccacgttgctggaggcggaaaatcgggcaagtcggaacattgtagcaggtgtcaagttgtgttatgtgatgcgaaagagagctgatttgcgaccctgatgtaaatgctcgacttcggaggaaataaggttccaacaagattttgctacaccaggcagacctatagatggagatcattatggcattttaagaagatgaagagatgataattcttgtaccaagctcatgattgaacctataaaagtttgaatgctttggtccgaattgatttcgactagaactgaccgagttgtgaagtttttgctgctcaaagagatatagtcacgtgtttggtatcattcgagtcgctaaaacgtgccaattttcatattacttttcttttttatctaatgttactctggaacaatctggtttgtatgttcaaaattcttattatgtaatcacgaatagtggttataatcaagaagggcttggtgaatatgtattcacctggagattaagataggtgggccatctgaccactcaatctgaaagctcgtttatgctgcttcattgatccctagaggatgtgtaattcacatgtacatactgccctatagcttcgaggtgtcgtcgccattgtgtggcctattgtactgctagctacgcgataacagccccttcgtctcttcaaaatgcaaatccaatcactataccatatataccgtatggtccatttttcgagataagtcgtctatgtgtgagcccagatttccttcttatgacgcagtcgtgttcaagcgagctgctttaaaagcatagctgctggaaaccaagagttctgatttttagtctccgacggtattatacgccacatcatctggtgaaaaatccggtgtcaaagagagactgtaaaggtagagtcaaccaaacagaaatatgacttccgggctttccgagatcttcatgcttgcggttaactgaagataccccttcggtagttctctctcaactgctgcagggtagctctctgatcatgaggaagggaggccaactgggcatcagtaagagccagcacctggttgatcatctgctgctgttgaggatccagatgcgtgggtgccgccacgtgatgttgagcctgaggctggggagtcacgtgctgcggctgaggagtggagtgtgccggtgcctggggctgctgacctccgacaacctgttgaacaaccttcgcgtcaatcagtcccatcaggagcatggcctggactgctgcgtaggtgatgggttcggaaacctggagaatctgggccgcttcggctgggttctttgtaatcaaagtcttaagatgagcaataagatcaagcagctggttgggttgaagagccgaaagaacggtggaagtcgcgtcgggcgtggtcagcgtaggagcaggcgtgggaatcggagtgctggggttgggggtagtggggttaggtgtcgactgctgacgatcgtatccgtgaccctgaccaccgtatccctgaccgccatggccaccatatccttgtgcgctaccgtatccctgaccctggccgtatccctgaccctggccgtatccctggccaccaccatagccctggttacccccatatccactctggggtccatcaggatggggagatcggtagtctctacctccatctcgaccgtatccctgtccgccgtctcttccaccgtatccctgatctcgcccatatccctcacgtgctctctctgctcgatgttgctgcatgtcttgtgtgaaggctgttcggatctgacgttgaccgattcgcacgtctctgagagactccagagctcgttcggcctcgggtatcgacgagtactcaacaaatccatatccttttgatcgtcggttgtctgctgggcctcgttcggtgaccagacggaagcccaccactgtgccatgtcgtcccagcatgtctcgaacctctggctcggtcatttcaaacggaaagttaccgacaaaaagtgtccgcgatggcggttgcggcgtgtttctgtccattttgcacttttcggattagtgattgctgccgtggggcgtatgttggatcgtctgctccaaagttgtgcaggagaatgtggtgatgtaagaaaagaggtaggttggcctgcagaagttagtgaacaatagggttattatggagacagaggagatggacagggggagaaaaacgggtgattggtacgaatatttacatgttgatgtcattctgatgaaaattcttcgatagagaagacagaaccaaaaagatccatgtcaattcgaatctggaaatgttggagccgttcaagtccaaaacagacaacctcgagagtacgagtcatgtttagatcggatcgggcagagaattgagatgaaatgtctggatagtattgatgaattaatgtacggtgactgttctctctcaatcaatactgctaagagtgatccatacagtacgttctatttaggggatctctagtacggtagggagagtatcgttgagatcacacaagtcgtatactgacaatcaccatggacacctacgctgcagtacttcgaattctgcgaccagtaaaatggcactattccacctcacatccacacttatcaaactacagtaattgctcgttgttatacaatatacagtacatttcattaatctatctggtcgtgtttcactcggctcttgctaaataacctcacctcgctggattcggtctctgagctctcggatacttctctggtgctcgggggccagagcgttgatatcggcttcactgagagccatcacctgctgaataagagcagcattgccagccacaggatcgggtgtggactgggcaggagcagatggggggttgccgccagcattgagggcagggttgcctctgacaacactcaacacccgctgttcgtccaccagacccaggttcaaaagacattggacagcagcgtaagccaactggggcgcctgagcaaacaagtccgccaggagctgaggcgagtttttgctcatgctcatcaggtctgtcaccacggcaaccatctggctctttgtgtacccgttcatagtctcggacacctgctgagcaggttccagaccctgccgaagaggaactcccgctggcaggccaggacgtccgtttttagacacattggggttgggaaatcggttctgagacgcaaagaactctcggacttgtccctcatgagaatgatccactcgcaattgtctcgagcccacctgaaatccattcaggtttctaatagccgatcgggcagtgtctgcatcggggtattctgcgaatccgtagccctttgaacggccggtttctttatcgaacatgagctttagggaaatgaccggtcccacagatttgaaaatgtccagcatttgctcctctgtctgatcgtagggaatagatccaacgtaaactactcgatcggtcattgtgaagtagtgagtgtgctgatggtgactttgcgggtgggtgcttgggtgcagtcacgagatgtgtcacgaggttttctggatgtctgactaagatgtcggctgggtaactcgattggaaatgcaggtgatcgagaatcggagaacgtggggggagtcgggcacttgacaagacgacgactgtgtggctggtgggtcggtcacgtactgttcaagtcggaacaactgatgattttatgtctgtgacaagtttgcgacgttgaataagtaggtgggcgtataagcacgttggcaaacggcgtgttgagtcacgtggtggaaatgcaaggagtagtagggtcgaaatacagtcacgtggtgggtttccgtgtgacaatcgaagactggtgttgatgttcaaggtggaagtttcagcggtagatgagtagactgaaatgtatgcagattggaactttgttgtgatgaaagtttggagcaggtggaacttggagaagaagagaagaagaggagagaagctgatgattcgaagtcaagtggcttctgtgtggttgaagatagttctggagtgtttatatcaaattttcagagtaattttatcaaaaatgaggattctaatgtgacgttgttgttgctaacaaggaaccttgtttcgagtgctggcagcatgggtgggggagttatataagggcgaataatgtgtgtgttggtatggaaataagtgttttggttgatttatttggcaatttgggactgtttaatcgtgttgttgaagtatcagaactctgcactcgaagttgagtattttatattttcccttatccatgatatgatgtttacttgagacagtgcgaggacgactgcagtatgtactgtacagtactgaactgtacttgtactaagtactcgtaagtaatttagttgggatggcaaagtacatggcttccgaaggacatggcaacgcttgaggatacactgagtacttaaaggtggagtagtgcggtcaaatttcgaatcagaactcgctcagatgatgttttttgttgttggttttttagaaacgtttttctttggttttttggagacgtttttttgttggttttttggaaacgtttgtctgtcgacttgaagctcagttgacatgtgttgccggtttagactgtgcaacgcaacagcagcacccggagatatatcgacaagataactttcgaagcttgtcgtcagactcatttgctcacgtgacacacactcctttgctcattaggccgtcgtcaatacgcccaggactctcctgacagtgatcagcaacttatctgcgccaaagatctacaagtctcacctgagttcgctcataacctgtactgtaggttatgtccgtttaaattgattacgcctatgtacccaagtaccggtagtcctacaagatagggcgtccagtagcaagtgtgaagtctgcgcatgctgagagctacccagggtaattatggggtcgtcgtactcaccgcacgcccttacaatccacaaacaggctcttaacctgaaaatgccggatatatacgtctctggcccaatctccaaccacctccaaccacctccaccatagtaatatcaccgtgcatattgctgtgccaaaatttcgtctcgggcaaaaataaagtttcacattggaagcagtctcacgcgaacaattcagcactcggtcgagacatcatctctgtaaagtcatcatcacatcactaccatcatgggactcagtgttgcggaaatcaaaaagctgatggctgacctggaaaaggccagcggcgaggcggtatacgacattctgcaggtgttgcacaaggaggtggagcctacggagaagctgctgcgagagaccaagctgggtattgccgtcaacaagctgcgaacctccagcgacagccggatctcggacctggtcaagaagatgatcaagtcgtggaaggacacggtgacggcccagaagagagacgcgtccaagaaggtagagggcaagaaggagaccaaggaggagagccgaccggtcaagtccagctctgcgtcttctggtaacgccacttcgtatacgcctccttcgggccaacgaaccccggccaaggacggtgtgtctacagaaatctactcggacaaggtgcgaaaccggtgcatcgatgtaacctacactgcgctggctgtcggcatgactgcgcaccccaatgaggtgctcgcctgcgccaaggccattgagaatgaggtgtacaagatggagaatggcaccggcggcaactaccgccccaagatgcgatctctgtacatcaacctcaaggacccaaagaaccccggtctgcgaggcaacgtcatttcgggcaagatttcggccgaacgactgtgccgaatgtcgccccaggaaatggcgtccgacgagctcaagaaggagattgaggagatggagaagcagaacctgtttgctgctcgaggagccacggaacagagagccgtgacggaccgattcacatgcggcaagtgcaagcagaagaaggtcagttactaccagatgcagacgagatctgcagatgagccgttgaccacgttttgcacgtgcgagaactgtggtacgaggtggaaattctcctaagctgccgttggtggcgatgacgtgggtcgcctgtgccatgggggagtggacggaggagtgtgtccatattggagtgcttttggagtgctagacagaagagctatgtctgtgactggctatcttcgcaatcgagttctgtgaattcgcaaaaggggagtgtatatagttagataggttatgtattgttaggtgttaggatacactgattggaggttgagtgttttaccagtggcagtgtgtgtaatagtttcagatggtctacctgtatatttgtgctctggcacgcgatattcactacaactaccgtatgtactctgtaacacaaacaaataccgcatttgatggacagtatcctgttgtacttgtgctggttgatgagtggaaaacacccaactattagttgattatgaaatacaatttagttaaaaagtagttgagattaggaggcgtatcaagaactactggagcttggggttggtcaaaaatgtattgttttgagagagttataaaacgtctacatagtactgataatactctagaggatccctggggttcgattgtagatgatcggaaacccattagcaaccaccacagttggggtcaccgcacttggggcagtgcttcttctgggtaggagtaggagcacagggcttggcatcgatggcgatggtaccggtgatggtggtgtagtgggtggtgataatggtggtggacttggggcactccttctgggggcacttcttggagtggatcttatccttgaactggtggatgtcctcgggggactcagcctggtcgttcatgggggcggcgacggcgagagcggccatggagaggagggcgaggttcttgatctgcattgtagtgggtgtgaagaatacttgtttgatggagagtaaagagggtctgggggtggtttatatagggcctgggaaaatttggacattccttagagtcatagcgactgtcttgtatcgattaaagcgatacgacctgctcaccttgacggcataaagtagctgcttgacatgagatgagtgcggagtttggatgttggagagtgtcagaaagtgtatagattggtttgaaacagtttcagggtcacccaagcccttgtatttgggagtgtgtatgtcttcatctggttatctcgtttctcatcttgagttcaatgggggcggtcgagtatcgcccgtcccacacgacacgaaggaggaagagtgtcgcagagttgagcaactagctctatacattcagattcatctgagttgaaaaattataggtaattcagtaaggtgcaagatctcttagcaatagagaagttggtctactatgtacatgctgctgctaatgtccaacaaatacacttatctagtgtttgtcagaaggaattgaaactattcgaatcaatttatacaactaataggacatcatatagctcttcagaaactccctgacattttccaagtctttctgagacctctactggctatactatgggtcgaatcaatatcagtgtcggcataaagtagcatgtacttgccatttccgaatacttatagacattgaactacggatcagattcccgatgctgctaagtattcattcagattgctattatagactgtgcggcatatagtagacgtggtatggtgggtattgcagccttggtgagactggacacactgtaggcaactattagtcatataaagagtgaaacaggatcaagagaagttgcaatatagtgacaggggtaagatatccgttgacatgattgtttactagaatcttttgttcaactggtttatttcaactatctgtatgtctctccgatatctttaacaaatatacacttctctttcaactaactgaacaacaatcattgctcaactctctacgacactcttaaacacgcggagaataactgcaattcactcacaaccgtctccttctacctctccatactcaataaaacaatattaattaccctctcaccgatagtcacatccaggacacattttatcaactctgccatttcccccaatcgcaacatcatgcagggagctgcacctaatttacaccttcaaccttgggtgagcaactcaatcacaacgttcccacaatcaccaccaccaccccacagcggtcgatcatcagcccgaaaaaaagacatgctccgaatatcacgtgacaccaaaatcgtcgcgcgtgtcactcacgtgactaaatcccgtacctacgccacctcgactgctcccaagctggttgtcggcctcgagatccacacacagctgctcaccaaacgaaaactgttttcttccaccacagtaccttcgttgtcaaccacgcccaacacaaaagtcagctacttcgacgcagctcttcccggaacacagccgcgattgaatccccaggctctgcttctggcgctcaaggcggccattgctctgagatgtgatgtcaaggagctcactgccttcgaccgaaagcattacttctacccggaccagcccgcaggctaccagatcactcaacatcgaaagccgctcgccatcaacggaaagctgaagctcaattggtgggatctgtacagtcagaatgaatggcctgccctactcgctaaggaggccaacactgactcagcagacacacgcgatctggcatctcgatctatcgacgttcctattcttcagattcagcttgagcaggatactggaaagtccacttaccacggatcagagaccctggtggatctcaaccgaactaacatgcctcttatcgaaattgtcacagcgcccgtcattcataccgcctcgcatgccgctgcctttgtcaaaaagctccagaccctgctaaaacgcattggtgtgtccactggagaatttgagtcaggtgccatgagagtggatgtcaacgtgtccattggagaagacggagagcggtgcgagatcaaaaacctgcccaacacctcttccatcgaagccgccattgaggccgagtacaaccgacaagtagaactggtaggcaagggaggaactgtggagaagtcgaccatgggtttcgatggcaagaagacattcattcttcgatccaaggagaacgctgtcgattacagatacatgcctgaccccgaactgccgctgatccgactcagtaagggtactttgttgaaggttagagacagtctccccgagctgcctgacaaggtcttctctagactgacagatgatccctactacgtgaccaccaaggacgcccttacgctgattcacgtggctggcctgtctgactactactttgaggtctttgagcgagtgagcgaggagactgaggatgccaaggctctcaagcagcctgtcaactgggtggttaacgagcttcttggacgagttcgaaaggccgatgaggctcgtgctgccgagtctgccgagtctggggagcctgatctcggtgctcatgactacaactccatctaccctcctgcaaaactggctgagctcattttggccgttcacaaccaccagctgacgcttccctcggcccgccttctgttccagcacttcctggctaaccccgaggatctcaagaacatgactatcgaacaagccatcacggaattcgagcttggtgagtctggagatgtggtggatgcctgcagacaggtaatcaacgagcatgagtctgttgtgaagtctgttaaggacggctccaagccgggttccatcaagttcctgattggtatggtcatgaaggctactcagggccggatcaaccccgccgtaatcgagcgtcaactgaaaactgagatgcgacacatgtagactgtttagctcatctcctgtgggtgtacaatatccctgtaattacgatagaataataatagatttactgaattgaatcagacaatgtgcacgtgtatgagaagacggctatagataggtcggctcgatctatagagctcactcagcgagaacgccagggacttgcttaagggcctctttgacagactgaacaccgaccttatagtccgacaactcgttatagacctgacaagaaagtcgaatgtacagcttgccgttgtggaaaaccggaggcacaaaagtgtcaaagttctctagagggtaggtgttgatcacttggagcagatgctccttatcttcagcagatgcctcattgagccacttttcgctcacgggcagtctgatgttgaccatggcggttgtgagtgttccagcggcgttttctaggacttcagttccgaagaagtcggcagcaaaagttcccaccttcttagccagctcgaagcagtaatttcggatcgcctcttcgccgccaatctgttctctaaacttgacagcagcaggagtagagaggtgagtggagaagtcagtggtaccaacaaaagtgaatctgtcgaccagacggcggctcttgtccagttcagaagctgcctcgaactcatcatcaagataagtgtgactaacgggcaaagtgtggatcttgttgtgatgcttctttgcaactacaagcacagcagcacctcgtggaacgtatccccacttgtgaaggttggaaacgaagaaatcaggctcgttctccttcagattgagctccacaagaccgataccatgggctccatcaataaaagacaagacatccagatccttacaaagctgagtaagctcattgaaaggaagaagacagccaggcatggaagaaacagtgtcaaaaatgaccatcttggtcttggggttctccttgatcacctttcggaacttctccacgatatccttgtcactatcttcggggtaagtgatgtcgactttggccgacttgactccgtatcggttctccatgaactgaagagtcttgtcgcatgcaccatagagagtgctacagtgaacaatcacatctccttccttcaagggaagacttcgaatgacggtattgaagcccacagaggcgttgggaacaaataccgtgttgagcttctcagaattgatccatttagacaccaactctcgagtttcgtcctccatcttgtagagatccactcgcataaacttatctgtgttcttctcgatctttcggatcagctcgaaccgtttctcctccacatctttgggagttgctccgaacgatccgtggttcagaggcgtattctgcgagtcaaagtcccagaacttatgtcgagcagtatgtccaaatgtcgtcgtcattgcggatgtatggaagtgttactgctgttgagatgatgcggttgtggggtttatgtatcagaattgggtttagcggggtagggaatggagatcattaacttgggctattttgatccaaatgaaatgaaataactctcaatcgaatccccggatcaatattatttcagctatataatttgtatatcttcacaatagacaattggccaacaatgtgtgacagtcctcgaccaacagagttcatgactcaataagcgagattactaataacagactaacatgcggctgaggtcttccgaactctttgtaaatcaatacctccaagagtcataaccgaagtaccgctttaggacgagattttcaatacttctttgtcattctacgtgcttctccttttctcggttcaatctgcatgcttcgcggaacgtgtctcggaacgttatggtacgtgataccagtcaagtacatccagtacagtatgtacagatatacactacagtacttgggattacaatctgtacacgataatatatcagatacaaaatacaacgtgatattgttttaaatcacagccatttggtccaaccagaagtcccacccttgcagatcaacctaccaatacgcgtctcgactcaatgaaggtatgactcggaacaatcaacgggttaaatctgtttcaacgacataccatgaaacgcacgatgtcatcagagccgccccctccagttaaacagcgtgctttgcatatccatttggcgcgttcatcacagaccctagatctggagttgcacctgttcggttatcggttaccccgcagtgttaatagagggtatttttcagttcagaaacaaacggatagccgttgtcttaagcgaaactgaaatatggcagacaggtgtaagacagacgttcaaagcagtcaataacagaagcaaatggagtgatgaaagatgactaatagaacaatgggattcagctggaaatagtggtgttccattacgctgatttggtgttccatgcgccccgtcgacatctccaatgaatatcaaccatctaaactaaatctccaatgttagttcccttttcctcccaattaatcttaaaggtttacttagctcttcttctggcattaagacacacttcagacgcctcaaaagtgatttaattgctccaatattttagcggatgacccagggcggtggtattagcaacctacaagtgttgtaatcactcaatatctcttccaatatctccaaaaacaccccctttgcacccccaccaacctaaaacctctccagacaatatggaactttaaatgtccccttaatggcaaacatccatttacacaccacccgaaaaatggagaaaactaaacacacaaaatacttcagccgctgcctgtttctgctgccagcacaagcgacttcctacgacggaaaccggctctccatcgtctacttctgcctgagcggactagatcttctgggaaccctggatcagttcatcaagacagacgaacagagaaaggagtacattgagtggatctacaagcaggtggtcgagtctggggagggatttcgaggatcccccacgttcaagctctgtggacatgagcatagcgagtcacgagagggagacaacagtgagtatggggaaagaggcggagatgtggttatggtgatatagtaggggtgatcctgaattatgaggagtcatcagggggttgagagcatcttactgagattcccatgttgttactgccgatgtctgttacatggcccgagaccatttccctggaatggactcacttttcttgatctgttgatcccatgagtgtgaaatagatccaagtaaatagagcctggtttcggcgcctctcaatgtctgtcttgtaatctgccacattcttatagatactgaccccgattcatccgcttcgtttcacgctaactcagaatatgacccggctaacctcgcagccacattcttcggccttgcgtgtctcggcatcctaggtgaccgggagatctggacacgtctatcgcgtgacaaaattctgtcgtatgtggcttcttgtcagcgtgatgacggcagttttggatccttttgcattgatggaaaggtggccccagattatgatatgagatattgttacctggccactggcattagacgactggcacgtgatacctcagagagattgtctagttcgcgagacattaacatccctgctatggttggccatatcaagaacacagagtcgtttcagggaggcattggacaaggtcagacgggcaacgtcaccgagccgcactccggactgacatattgcggactgtcagcgttgaagaacgccggccaactgaacaacaaggagtggggaacaacgttagaatggcttgtgggcaggcagtgtgacgagagaacaagcgagacgcaggtgtccgagtcatctaagagagatgacaatgactcgtcggaggaagaacaaggagacccccagactggaggttttaatggcagagttggaaaactggcagacacatgctactcattctgggtgggtgcttcattggccagtctgggaggtacgaattatgtttcggctgatctggcccgtgaatatcttctcaacaacactcagaacacacttctgggtggctttggtaagacccccggcgagattccagatcctttgcattcttatctcggcgtttgtgccctgagcatctttggacagccaggtttgggtaaggttgttcctgagctttgcattagtgagaaggcctttgaaacgttgactggaggagatagcacgagtgtggctgtatgagttatgttaatggaacctctctgatacgcgatacaactaataacgagatggcacacaccaagtcctcaatgttgagctgcaagacatttcgaattgtagccttttgtagtcatcagaaatatacaataaattacatatttatatacatgtccaggaggagtagcaatgtagatgcaatgtagatgcagttttaccgctggtgctaagatagcgatggagatcacgggctgttgtcacctaaagttgaggtcctggaagattcattctctcgaaccgcttgacaagatcttcgtaaatgcaccaggaaataccggcctggcacgcttttctgcaaattcgcagcgccaggcctctaaacagcgcctgaataccttcatgctgtataatggtcttaacggaggtgaggaagttggggtactctttgggggccaattgcattcgagttttcacagtgtcgaagggattagtacaggtggtggcaatgcctgcagacgttgctgctgccacggagttgatcatggcagaagaccatgagctgtagtacttttccgaatggctagaggttgtgatgtcggaaaagagaatgctggggagcgccaccttgagctgttcgtaaaagagcatgtatagaccagcgtagggggcgtctcgcgcgaaggtcgcagcccagccgtaaaagaagcctcgcattccattatgcttgtaaattgaggtggcagcatcaactatgcttttgtaatggtaggtggacgactcgtatcggaccttgatgacagtgatgggcatcaccagcagtcccactgtgccccgtaccagtcctccactgatgaggttctctgtgttggtcagcttgggcaagcttgatgtgcttctgtcgcctacggtcaggcgtcttcctccagcaaccgcctcacgcaccgtgttgagacaggtgaagtacatggccgagcccaccgacattcgcaatgccgacggaagggtgcctcgccatagatccaagggtgtgttgagcgacttgatcacttggaccatggacttgccattggattgctggacccgggttttgagcagatcaaacggttgaagaacgaccgctgacaccaggccgcttgtgaagccagcataaatgtggtttttggacttgccggccatctcgacgacttgatcagcttctctgtcgtagctgttagtggtggatggtgtgtggggttgatctgggatgataaagtttttcaactaccaaccatgtcaaaatagtgggcggtaaatggcgtgagatgtgcggtaatagtagtgggaaacccatctcacaccgtttgtgacccataaccagttgccacggtgtctaacatttctctgtcctcatatacgcacacacaatatactctctacatacagtccaccactcacatatcagttgtatgtactaatagcctcatgcaacattagcttcaaggtgcataacagaaacatgtattatcgcggcagtttgagagcaatcgacatggagatttgaaggagtgcttgaattgacgagttgagcaatctgaagagattgaaattgaaaatatcttcgaatttccctgtctggacagtaccgataatgccgaggtaaatggaactttatctgacataagctcccttatttggtgcacacgtagatgtccactttctgtatataatgaggggacgtgaagatgatcacagggtatcattttgaagccctcgatctcccgagtacaataatcaagacaaaacagtcacatcttcattgctcaggtcaatccagtttctgtcgtcgaaatacactccgttttaagtacgcgtattagccgcctggttggtcccaaacccaccactataagtagagatcctcccaacgtttattgtgcaaagtattttccgcaccctgaatggggcactactgtaccagcgttcatactcgtatacttccacgccacaacagcacccattagaaccgtggaaacgtgccaatgacatcctaaatgaagtaaacccgggctaaaatgcttctagcatctaaacaacaccaaactatggggatccagctaaccaaaaacacagttcggaacagtatgaacttttccacatattagcttctgaaccccgctatcgagtaaccccgctatcaagtaaccctgctatggagagtatgactaacttgaagatgtacagtatgtacaagtatgagcatgagtatatctcatacaagacaagtgagacatcacgtgataattgaacatttcaatcaactcgctaacatgattggattcttgtagaaatttctgtacgatcatgacgcctgtcctggagcactcttggtggctgattatagcgtgttgacctgtgttgacatatgttgacatgtgttgacatgtgttgactcctgactaccaaggctcttagcgtgcggctagtgtggggaacgaggaaatgggcccatatttgtagatatccgcttatctataatgttttgtgcttgtaatatggtcattattatctgtctttaacggtttttccgcttctcgtttccttggtccgacatggcgtatatattttcacttgcatttaatctatgtttcaggtttatcgctactgtatcagggagggatcaatacttgtatagtatgcaaagtatcgcttctgcttaacatctcctcgtatctccatagctatgccccctatagatgcccgctatgaccaagtaaataccaaactcgacatccgctaagctgctgaccaccgtgtagcgtctccagtccctggagaggaggagtagtttttagagccatttagcattttttagaatttaatttcacgtgctagtgactggaattaattgagagcaactcgatagtacggactaaccgacgagccaagagtcgaccgacctttggaccctcttggcttcgctctgacagatgtttacatatctttgagactcccgaatcctctccaccttccttcaagatatcaaagtcatcatgcaccctgcaaatccactctgttcccgcaagtttatttgcggctaaatggcaggatttggagccaggtttgggggcgatatcggctgtgtcaacgtgtcatacggaatcctcactcggccgtgacggctgtcaaatcgtcttgtctcgtattgttagcgcggttcggtacaacaggtggtcatcctgtctcccgtgtcccggggcttgctctcgatctgcctctgctcgcctctttgcctctctttatgggcgttccgtctcccggagaaactattgatccgatgccctgaagctgtcctagcgataactgtaggggtgctgaagctgtcgtctccatgtatgatccctgactggcactttctcttttatcaacgctccgatatactcacctgcatgcggcgaggtgggggtgggggaaaaagaaaaagtacgcggaaaaacgaaaaatggcacatctgacagccaaaactacatgctctttccgagccctggcatgcgagacactacttggacgagatatactacaaacactcgaactatacaatactttcaacttggacatactcatgccgtactcctctaccctacttcctcgtacctcctcctcctatataactacaaacctcctccgatgctatttaaagactgaactcttatacatagtgtaatacagcgtcgtagaatactgcccatgatacgactattgtacaagtactggcaataccttgaagaaaataaaatacggcaacatcggcaaacctctcatggaagcagaaaattagtctcgaaagctccatctacatgttcgttcacatgctgccgtcattgcttctggggccctttgtttgggccagctctgtcaaagagatcaacagggttagccgcccacaagccttttcacttttggcacctgtcactttgtaaacccagttgtcaaatatgggtttccttgtcttcggcgaatgtaacgttgttggccatggctagtgcttcagatgggagctgttggacacgatgaaggacggtccaaggtacttgcagacgtgcaactccctggacaggaaaaaccaagtccaaacaagtctgttttgtctgtccttctccacctacacaagtcgactttagacccagtattcgtaattttatgtattcggacttttatgtattcggacttttatgtattcggacttttatgtattcggacttttatgtattccgacttttatgtattttagagtctcccttgtcgattcagcaaaccaaacaaagcagctgaaaacttgtctccatttaaaatccagttgaaactgttggagaggaaaagatgataatccggtatacccctctcgatagtccatcatagcaaccggagtagtatcatagacacagactcggaatcttagtcgccacactacatccactcagagccagaacagtgtatatcagcacgcttgtgcggagccctgctacgcgattgttgtttgtttgtttttttgacaaaagactatacatcgcctgtcgctggaagacaatcttgagtctcccggcccttcccacggcccatgtctcaaatcatcagtaaacattggtcatgtgcaagctggtcgtgcccaaatgcaagcttgtacccctgaatagccatcggttatgaataaaccaacaagtgggcaaggtagatcgagaacaacaaaattaacagcaacctactacgactgtaaactcgagcacctacttgtagttattctggactcaagtctgatgcataaacttcgcccctacattagcgcaactcaacgtccccaacgttgacgagggatcagcaaaagtagaaggagcaccagtgagtttttagacgagtttctccacatgttctccttctgattctactcgtctttttgaagtcggtcggaccattggctctttattgcaagtgctatggtagaaaagaatcgttggacaaattttaaaaaaatgtccaaccccgggacgtcttagacatcagtttcaacgcctattataggccctaccagagacgctcaaagatgacgaatacttctttagttggtccctagcaccaggtatagtcttcggcaaggaaatctgttccgacaagcaggtcgttcagaccatgctgtagcgtttttctcatggtaaccgccacaatgggtctcctcagtgtttgacaaccgtctacagtactttcacttgtacttgtacttgtacttacactgtagcgttggacgaggtctttttgagtctgctgacgatgacaaaagaaaatatttggagtcgaagagttgtagaaaaacccacaagccagacgagggcagagcggatactaaaagagcgaatacttacgcggatacttagacggatacttttatccaaggaatagatataaatacagtcgttgtagcatgcccgtcaccagtacattggccacttctcgacgcttttcttacaccacatgccatcaacttagcatcggcctacacacgagaagctaaggaataagccaacagaagaggggatgcactacagtagtggagggttactggttgaggaaaaggctttgaaccgttcctcgagtgatacaggtggatattatcaacagctacttccctggctatctcgatacgacctcgctggggcccttagatatgggacaagggcatttaactgttcgcaatttcgaccaggtgctagtcccctggcactgatctacagacgaggccttgtcattgaaattcttccgcataaaggacactatcgactcaactgcactgtacagagctgtgcagctgtccgcaaaaatgtccgccattgagtgttgtgggacgtcctgaggggttgcggaggttcgttaacggcggtcgaaagaacaagtccatcagtgagtcaagtttaatacaggctaccgacttcccgaaattggatagcgactggggaacaattgtacagattccgtggagacggcgagagtgtttgaagtttgcggattcgtacccgtttgaacagtacacttggctttgtcttcaaaagtaccactaatatcagttcgccgctacccttttttatgcctcctccacccatggacatctttaatttctattatcatcagcaactacacttgcaagccatgtcaaggccagaaatttctggtacgacatgttcaccattgctgaaatttcaaatacgacatcgtcatcactgccgcttctaatcaccgaactgaccctagcagatgggcagtctctcactcgagttattcgacttcttcgatactctcgcagacgctctacagaagaacggcacaaccacaaatacgccatcaacttatcgaccaagacttgagaactactacgagacacttgactgaaattcgagcaacaccggtatcgactaacagtgacaatcgtagcgttgttcaggtgagtatatacacactagaggacaccagcggaagcatcacgctggtatacttggcgcttgttgcgatggctcgtggacttgagaatgtgaaagaatgggggtacagagtcgtgtccaccatctcaggcggtcacaaaaacagctcagtttccatactgacggggcacgaacaccaacatgcacttctacagacatatgcccagcagctcaccaccgccaaatactgccatgaagacgaccatactgttatttaaacccttccgccccttgattattcttttcacgctcgattatcgccagttgcgttcagtactttcctctcgagatgactgacatgggtgaacgaggctacttccgagagagcaccaacgccagcacaaataagcagacttgaagacacctggtgggtgtgccattaccattaccataccgtcgctacataggttttattcatccactgcttccaatagtgtatattacatgctgttcaattatatgtatctatctacattgcagaggcatgaaccgtgctcctacagtacggatgatgttccactcttcagagcggactcagttgatgcagaccgtgtgttgtgaggacttggcctccagctgtgtacgacgtcgcgcaagtctggctgagtatgtgtgtgtgtgtgtgtgtgtgtgtgtgtgtgtgtgtgcacgtgtgtttatgtgctgccgataggttcaaattctagacgtgcaaattagaccgggttggaatgaggctgcatggccacagccggtccaaaaggcaacgctctgctcatcaactcctccaccgttaaatttctcagtcgcacctgctccacctcattcacaccctccttgtgtgtcgccagagcgatcacatgattgttgttgagcatgaaaatctcgtggtgccatctgtcctgtgcgactccatcgatccacagctgcgcagagttgctccagcctctctggacagccacggcgcccacaacgtcggttccggtcttgtccttggccgcgtccatcagtctggccgtgtccaggtttctgaactctagcttggcaaggtccatgttgagccccatgccaatggccttggaatacgactccttgagtgcccaccgcaagaagaactcgccattgccggtgctgtcgctggtgacctgagagtactcgaacggcgagaaaatctgtgaaaagccctccatccagttcatagtccagtttgagggaggaacagtcgaggtgatatccactccaatctgcttgccatcaggacgaacagccacaaccaccagctcgctgtggtgactgatgttgtagtcgaacggcgagttggccacaaatgacttgccctgcggagtcttcgaaatgacaatgtccgtccacttcttgcctgtcagaacggtggcaatataccgctggagcagctgagagccgagagccatcttcgcatcgcttctgtaccgaaaacgcgaaatgtcgagctgagattcgacaggaagcagtcgcatggcctggttgaagtcgttctgggagttccagatgggccgcacgtccagcagaaacaaatagacggattgcttggagttttgccaatcaaaaagctgtgttagtattgaaggctgaaggtgtgtggacgtacatcaggaacaaaactccgaggagagcaggagaaacgcagagcacaacccccatcgccacagaatattggccatgtcgtcgctacaagtctggcagtcaccatcgttatgtgaaaagtgtactttggcacacgaggtgaacatttatgtccttgatgaaaacgaaaaatgcaaaatcaaaaccaaaaaaacaccaaccacgcatgcaaacaacaacgatggtaagacagatgttggcagttggagagaaaaacaaaaaaaaaaacagacaaagctcggtgcgtgtgaaagacacactgtggaagtgggggcgaggggcggattgaaattgtaaggccaaccctggggagagatatcacaaaaaatatcacacgcacgcgttggggtgggggggtaaacttcagctgtaagacagaaaaaccctgagtcatctgcccatacccatttacaccttcatggcgcaattgggtggcaagaaccgttccaacacccagagcaatgcgtgtgtgtatgtgagtctggcaatgaggcggtcgcaaaaacaagccaaggcactaaaaaaaacacccccttcaagtccacttgcacttacatgtgcaacttccgcacttccacctgcactgtactagacaaccgcactactaatcacgctactaggccgccaccataaaaaaatcacttggttagcggaagcagtcccagttaattagtagtagcagcataagtagctgagccagtagttgcagaagtggctccttatggctgtgcatcggtcgattcacgtacacttgctcgtatcatcaatgcacgttcctgtaataggccgctcgtatcagacaggcgtccgtggcgatccttgtgtcaatactcacatttccacctaagtaatccgtggtgatgggttcctgaaccatgtagttcatgttgaagtcctggtcgagaatggggttgtagaccggctgcacctgttgcgggacaggttgctgctgctggacgggaatctgttgctgctgttgttgttgcacaggcacctgagaaatcatctgaatgtcgttgttcagtcgggggtccatctccatgcccaggcccatgttgacatgtgtgagaaaataaagtgctttgtgcgtaccagggatagggtaggtagtgaaatctgagttagtacatcaactctagacgatgggcgtcgcctgtgtagaagaacaataactcacccggtaactaacactatttctcggtggtcaatgcgtcagaagatatcaagacggtccgttttgcgtttaagccgagtgaatgttgcctgccgttagtaaatttattatgaaaaaccccactatgaatacatcagcctatactgatataccaagaagtgcaagggaggtggtcctgttccacctgaacgcggttcccgacaggcggcggtactgaagggctttgtgagagaggtaacgccgattctctctgcagtcgtaagacccaggtggtgtgtccgaggcagtatcgctttcccaactctagtaacctcggtagtgtgagacacactacccctaacggtaggacagccggacgacgatggcgcagcaattggcgaacgctgttataaaacaattcacttacgtgcaatgaaagttgtttgggcaataaacaataaatgtattagagccagacgatagacaacaatccagcagatgatgagcaggaaaattgagtaagatcgacgtggcaagaagagttacagttacgcagagttaataaggtgttgggagattagagttaccctgtcggatgactaactctccagagcgagtgttacacctgcccaggtctaacggggtttcgtcccgaagccctggttagaagaatcaagaataaaggccctgagcaaggaaggagccctgagcaagcccagaatcaacacgagcgagcttcgaccgagaagtaactctagtcgacgcagtggtagctgcagaacggacggaacgagtagccactgaagccgggggaagaacatgtggagaacaggcagaaaagcggccaggaatggcagggagagcagactcgcgggactgatgttccttcatgcggtcctggaactcaacgatggaagcggggtggaaaaccttgaggcggttgcggtggatacgccgcgggttctcaccgtcaacatcgttgacagtgtacgtgctggtctcagggtgacacgcggtcacgatggagggaccagtccaacgaggagtcagcttgttgtggggacggaggtcgtgaacaaaaacgaaatcatttacggccaagggatctgtatcagctgtgttgtgatgtttgtcgtagaacgccttttgacgctggcgttgcagggtcaggtggtcacgagcagagccaacttcgaaagtagaagcagcaagttgcaaggtgcgcagaaaagcagcatgagcggggtcgttgtgggccaggtcggtcttgccactgaggtaattccaggtcaggaaacgactttcgacaggcaagacaccagagacaccatacatcagctcaaaaggtgacttacccgtggatgaacgacgggtgcaccggtcagcccagagggcggtgtggaggtataagatccactgacgaccgtatttgcgcaggcagtggaggaggttttggtgaccgcgttccacaatgccagtcgattgaccatgagcaggagtggtgaaaacctgcttgatgtggaaatcttcgcagagatgcttaaaatcacccttgaactcactaccaccgtcagtgtagacccgacggggaacgccaaaacgagcaatgatgaaatcgtagaagaaagcggctgtggagagagagttgatacttcgtaagggcaccgcctcaggccagccagagaattcatcacgagcgacaaggacatactggtagggggcaatagtgacatttagccgtccgcggggggcagaggaaacatcagtgaactgaggggcagtggggaggaagtcggtgagggtggtttgagcagcgagagccttggcgggatcagccagatcggggtactccttggtgggaccatgaacagcgggaaggtagaggatgtccagctggactgtctcccaaatgagacggggaaccacgaagtggagactcgccttgagaagaccatggttggtggcttttgcacacgtgccgcatgatgcacgatgggacttcacgtgatcagccatgcccggccagtaatagaggcgacggagagcatgaaggatggcagcagcaccgcggtggccatattgttcatgggtagctcggagaacctcagacacctccttctctgtgaagagaacacgtcgatggagaccaggtgagctgatcagtaggagaatgtcgtcaaaaatgaagaactcagagcagatttgacgcagtctaggcggaatgtcaacaccatctcgatcaagatcgccggaggcaatggtggtgaaaatgagatcgagagagatgcctttgtggatgaaaacgggctctggaccaatggacaggacagtgatggaggccacaggggaccaagtcgggggcacaagcggagcaagctcatcagcttgtcgagctgtatcagcaacaggagggcgaaaatcgacaggtcggaagtcagaaaatttctcacgactcagccaatcggccactggattgtctcggcctttaacaaatcgaacctcgtaatcaaactgtttgatgtaagcaaaccaccgggtgaacatagcgttagggagttcaactcgggattgctgcagtaggaaaaccagggcctggttgtcagtttcgatcacgaaatgaacgccagtgacatagtgacggcacttctccaaggcacgttttacagcaaggcactcagtcttggtggatgcgtaggtacgctcagtggggttccacaaaccactctcgaaacggacggggcgacgggcagccggagggccaacactgacgatgtgagacattactgcgccccatccgagggaggacgcatcagtggtgatgacaataggtaaggtggggtcgtagcggtgcagaaccgcagggctcaccatagccttttttagcgccataaaagcagactcggtggcctcggtcttggtgatcttgagtttgccagccttctgcgcagcggagatgcagtcgtacagaggtgcagcgatactgctgaaatgagggatccacatgcgaaaatacaccacagcaccgagaaaagagcgcacaccacggacagtagtggggaactcgaaagattcgatcttctcggaactgccaggggacgggaagcggccttcagaggtagtgaggaaaccgaggaactcagcctcactgacgaaaagctcggccttgtcgaaagacacagtcagacccgcttcatagagattctgaagcacagccatgaggttgtccatgtgttcgacgatgtaccggcggcagcccggaaagtcgtcatgcatggctccgccatagtcagtcttaggcccgagaacgccaatatcgtccaagaaaacaacagcctgatccggaaagaggggcccaagtacgcgcagcatggcacggtggaacaccgctggagagttgcaccaaccttgaggcaggcgcgttaaccgataggagccaaaatctgtgttaaaagccgtcaagtcacgggactcgggagcaatctccttctgaccgtaaccattcttaatgtcaagcagggaagttacagcacgaccacagaaactctcagccaggaggtccgcgttgggtgggtggaaagcatctctcaaggtgatcttgttgaggccctggcagtcaaggatgaaacggtatcccgagctctttttgctcacgaggaaccaggcgttgcggtggggggaggagctgggctccatctggccgttggcgagacccttcatgatgatgtctttggcagcgccgaccatagccccgcggagagggaagtgctttgagttgataacgcctccctcttccacgtagatcttggtgggctcctcaatatggtgactgaggacaccctcctggtcttcgttgaaagcccagacaccctccatgtccgacatgcgatggcgacagagagcaagctcggccgggaaaaggactggagcaagtttggcatcaaattggcaagactcgtcgccagagaagttgcgatgtcgcggagaaggcttggagccgtcaccgacaggaaaggaaccgtccgggcgaagcttatttagaggcagagaacgcttgtgtagcggcttgtacatggcattgacggagacagataaagaatgcagagagtcttcaggggtgatttcttgggcatcactgagaacttcagcaaggtagagctgttggcgcatggacaggtcagtatccggttgaacctgaacgatggtagccgagtcgccaatgtcagccatgatgaaaacagtgttaccaagtacacgacactcacgtacaggctgctggcagcagctgcagggcgatgcaggaggtggatactggaaaacactgtcgaggtcggcagaagaaataaaaccactgagagcatgagcgtcggggggtctggcatgaagagcattgtctgcaaggttgtcatggaaacggtacgacgtgtagctctcctggaaaacggtgcctacatctgacaaggcggccgagactccggacggggcttccgacggggcttccgagcctgaagaggaggagcagagctcgttggagtcatccacagatgaggcatcggtaggcagtaaaggtccaagcgtaccgtcgacgggagcggaggtgtgcccaggtgatgaggagttgggctcgccagagacatcaccgtggtgcccaggtgatgaggagtaagactcgtcagggtcatcacgagggggaatgccaaggggatcagggccggagctggacgctagagccttgagaatggcggtggcagcgctcgaaggcgggccggcagactcacagtcatcagcaaaggatatggcaaaacagcctgccgctgtttcagaacggtgggagtaagatccaggctgaggccctccgagagatgaggcgtcaaggagatttgttgcttcatcaacatcaccacagagtgagggagtgggtcgaacgtgtgccatgacgttttggcgagacagcttggcagcaggaaacgcaggcacaggccggcggccgggcctcacaagacggtcaagcaacccaaggtgagcaacaaggccagctgaaggtctgtcactagggtagcaccggacgccagggttaccagggttctccactgaagcgacacggtaacgatcatggtcgaacgaaatgcgcagtttgctgatgtatccggtgccgagaatacacttcatgctgcacttcatgacacaaaatgtttcaagagtaacgacacccaggaaagtgacagggagaagcgcccagaaatcaacttttaccttggctccgtttgcgactgtggcgtgggactgtccgtcagaaaaaacaatcacccggtcaggggtgacaccagccttcgcgagtacaagggcaaagaaatcagtgtcgatgacgttgttagacgagccactgtcaaaaagggcgctggtctgttggtcgaaaagagcaatgttgtcggtgaagtggggcgagagtggcctaccaactttgtcgtcgtacagctgacggtcaatggtggtgaaaacctcctgaagacgaccgaaggtgccagagttgagctcatacggtgtggacgaaatcacgttgagcgcaagatccatggcacactccatgagatcgtccccgagctcaagagcgatggcttggatgtcaggacccgcaagccggtgccgctggtgacggaagttcttccaaatgtactttgtgaggtcagggcacacctggagaagctcaaaaagaacgaggccatcaacatccgacgccttgaggatgcgctcaaacaagtctgctttttccgattccggcagagcatgaatggcctcaagcttgaagagagggagacgcccagccttcagcaaggcattgtcgtaacgaggatgatctctggtgaagagagccttggagtcctctaggtcagacgggaggcggtccagagcatccttgtaatcttttaagggtgcattctccgcaacggcagaggcatcgtggatgtggttggtgacacgggttccagggctcacgtagtggttatcacccagacggggggggtgaacagccacacgagagctggggacgtcaacaacagcgcccgtggaggatgcggagtcagtcggccccactgaggagggattggctacagccttggttcgcttagcagtggggggagcagcggaagataccgtagaagaagcggcaccacgttttgtcgcttgaggcaaagcaggcgggggcatgtcttcacggacatcacgacgggggctgcgtcgcggcaacggagccactggtctgtcagggtgcttgctgtcgacaacagttttcaaggcgttgatgttggtcttgagagactgtcggcgaggatcgccttcggtggcgtaagcgggctccatgaggtcatttcggactgtagcgaaacactcgtaaagcttcgtaggcaatactacgttgtacttgttgagcaatcgctggaccgcatcaacaaagtagacacggccggcaactggggaagacggggccataacagcacctacaaaacccgcttcaagcgtggaggctttgaacgtgcccgggggagcagttaagcgagctacgagctgcatgaaggctgggtgtgccacaaggcgcttcatgttgccactgtaggagcctgacacaggcgcatcaattgcgtaagtgacggggaggggtgtgggctgttttgccatctggagaatgtgctggtggattgcctctttcgtgagctcaagctgggagtcagtggagtcaatgatagtgcgaggctcgtcgtaggaggaaaacgtatcagacagaagatctcgaggcacccctcctagacagacactgaacgtgccgggttggagaaggtcctggaagtcataaccagacgcagatgagtcagagtcatagctgttatccaaaggcccgcctgggtcttcaacgtgtacaaattcaacggcatttacgcggccagctagggcaggacgccactgcgcattgaaagttcgaagtctaggctccataagcggattcgaccattccttctgcttccaggaagtgtagagagcgctctgttttagagggaagtcagcatcaacaggcgatagatacttttcaaaaccctggtagccaagtcgggtgaaagacttgaagctgccaaggtacttggccttgaccaaggggctgccttcggagtcatcgcagttgaccagtgcatgggcagtggaaccacagaaaacacaaggagccttgtcagctgcccaggaggttgaggcatccgaggcacggattgtgggtttctgcacagtctcagttgagacagggccgtcggcaggcttcctggtggaacgaccacgtcccgcaacgtgaacgacgactttgtcaggttcaggcgtggaaggctcaggtggggcggaaggctcgacccacatccacacgtcttcgaaagataccgtgtgctgtcgccatctcagaagagcctcatcattgagatcgtcaagtcgttggacatgttgggtgatcatcttggcgaggggctggatgagctccgtggcaacttgatggtcacgctcagggtcggagtccatgccaaggctcagccaacgagtgttgtcacgagggatctcgcgtccgagggcggtgcccaggtgagtcggagcgagcttctgcaactggagacaccgagagagaaccggcagaggtgaggaggtcagagcggtgctcagagcagagaggtacgcacgtagtgtctcgatagagaaagcggtgtggtaatctttgaaccggaaacggagttcctcctcttgttcagcaaaggagacagcaggttcgtggtcaaacccgcgctttcgaaaaaggtcccggaggagacgttcgcaagcggtgttcagacgagcgtgggcacctggcttggttgattcatcagcagtctctgcttcaaaggtgcttcggagttggaggtactgttgatcgaagaggggctgcttatcgttgacaccgcaccaaaggtggaaagcccgagctctggtgctccaacggatgtcatcctggagtaggataaaggtagccacccgggaatcaaaagatttgtaagcgtacaactgttttcggaattcttcgctggacaaggaggggtaaacctcgttccggatgatggacttgagggcgtcggattcttttcgatagtcaacagaacccgtgtcactggcagcaaagtccatgccatgtaggacagagttacccttctggggggtgtcgggttcaaattcggaatcagccttgccaatacgggaaatgccttcaagggagctggtgctcgggggtgagtcgacacgcttgctgaggttcgcgatggtttcgtgctgggccgacaccaactggtgcaacttttcaaactccccagcctgatgtgtcttgaaagactcatttgactgcttgagctcgtctaaggctgagcggaattccttggtattaaccgcggtagcgagagtagtggtgatctcctggtgggagagcgtcaaggcgtccatcttcgcggtgagagcctggaactcgtcttttgttactttcgacatggtgaaaacgaaagaacggaaagggaagtaaaatacgctggtacgacagtaaaggcacaataaatctggcaggctatcactcgaaacaaaaacgaggtgtcgtccaccagatgtgagaaaataaagtgctttgtgcgtaccagggatagggtaggtagtgaaatctgagttagtacatcaactctagacgatgggcgtcgcctgtgtagaagaacaataactcacccggtaactaacactatttctcggtggtcaatgcgtcagaagatatcaagacggtccgttttgcgtttaagccgagtgaatgttgcctgccgttagtaaatttattatgaaaaaccccactatgaatacatcagcctatactgatataccaagaagtgcaagggaggtggtcctgttccacctgaacgcggttcccgacaggcggcggtactgaagggctttgtgagagaggtaacgccgattctctctgcagtcgtaagacccaggtggtgtgtccgaggcagtatcgctttcccaactctagtaacctcggtagtgtgagacacactacccctaacggtaggacagccggacgacgatggcgcagcaattggcgaacgctgttataaaacaattcacttacgtgcaatgaaagttgtttgggcaataaacaataaatgtattagagccagacgatagacaacaatccagcagatgatgagcaggaaaattgagtaagatcgacgtggcaagaagagttacagttacgcagagttaataaggtgttgggagattagagttaccctgtcggatgactaactctccagagcgagtgttacacatggttcatctgaggctgatactcctgcttgactccgtaagcttccagggcagatccgctgaggttggttccactgagcgacggttttttaagtccgggtttcgacaccgagttacgatgcagcgttgtgtgttgcagggtggaggatcctggggcggaggctgacactgggctgagcacttccggtctgtcggcagcctctctgatcctcctcttgatagtccgcacactgagttcgggcacaatctgtttctgaatatcttccagcgagtcgctgcggtcgtctgtgacctccactatcagcttgtcgatctcctccgtggttttccgcggacgtcctgggcgtggtacgttttcataatggcctcgttccttggaccgcttgatgaagtctcgtactgtggatcgcggaatgtccagctgcttggagatttccgccaggttttttccacagtccgccagccccactattcgtcccttgtcgaattccgtcagttctcgtcggtttgtttttcgagacatgagagagcaggagggagatggaggggggggatgttgtgggtcgaaatttagtcgaaatttagtcgaaattcggttgtaaaggtccgtgtctggtcgattttggtcggtttcggtcgatttggggtcgaaaagagccgtcaagcgcctcagtctctatttgagggtgtgtttgcgtgtttgcgtgtctgttgtgtctgccgtgtctgccgctgtctgtgtctgtcgtatacagctgcggtctttctctctctcctatcgttcgcaatctcaactgtgcctacttgaccgtccctggtggtgtcgccataccaaccttttgtacttggaggttggacttctcactttgtgccaaaacgccaaacagtaaaaataattgagctacatgctattttgcattttgcatgtgagccaaaaacctaagctaaaccttggagagctagagctagttcaaacgccgccagggagagctggtggagaatggatggagtggagtgctgggggcgcgggcggtctgcgtgattttgtcgggcggctcgcgacagcggattccgggactttttgtgtcgtgtgtgtggaaattcggtcacctccaccttcactccacctaccccacgttagcatagtgtatacactagcgagaacaagtatatgtactggcactcatactgtagaaaccgcccactcgttagacaagacgtcaatggaaggagaagctcttgtcatagtgtatccgaattgcactgtattgtagcgtatccaggcctgttgacattgtccactgtttgcagtgattttacaccgttgcatcgtactcaacatatctgtacaggtgcgagtacgactactgtacttcactatgtactgtactgtgaattgcacccgcacctacagtatatatatatacatgtgtctgacgtcattgtatcaatatactactgtcgacgagagagccagtggagaaggtacttttttcttcaacaactgtagaacagtttcatctggttcacttttggttcttgttggactactatacaaatacttataccgcaagccctctctctatactgaataattcattcctccagcaccactcccccagattgagatctaaatgtctcaccctgcagacaggctctctgtagcaaaagaagcgagcggagatcagcacgggagcgacatcgagagcaacaactggggtttagtgtcgtagtcagcgtcattagccggatcccccgctggttttacgattttcccaagactcgacttttgggtgctccagtcaaccggcctcgatagcttgggagctggctatgtgtgtcgctagtcaagaagacaaagaaccgagcggtctcttttaggttttccacccaaagccaaaaatcagcttgtcctcgaacctactgcccaggggtttatggtggccgtctattcctttgcgagagttgaatatcgcaaaacaaaaaaggctgggaaaattaaaagactgagaattcgaaatctaaagctgctcagggtgtcggcattgagttagaggttccccaaccctccgattgggctccgattgttcacgtgccggcggtccggggcaacaccagagaccctgtggagaagtgagcgccagacgacatgcacagttgactactgtattgtaggttagaccagctccctgcacccatttagtgcggaggccggtcatctccagcgccgccgggcggactggactatggcgggacatgactcgtctcgtgcaaaagagccactcgttgctttttgcaattgcccaaaaaaatgcccccttctttattctcagggagatactggattgcggagatgccagtgcatcaggcaagtgggcaggagcaggcgagcgacgagcgttagcgacaagcagaagaggagcaggagcgttggagaggcgaggaggggtatgcaaagtgctgatgtgggcggttccattgtattctgcgctctttcaaccgttttgttcgaccaccgcgtgtctcatctgcaaccctggcagacactggtctcgctctctgcggagtccccttgagtctcctttctgtttgacgttactttacttaactttttcttccgcttgtctctctctctctttctctctctctctctctctctctctctctctctctacttagttgcatcagcacttatcgcgctccaagcactatagggctcaacaacctttttccgtgagccgatgtcggagggctgtacgacgagcttgacggcttctgacgcaggtggcaggctgaccaaatctgacccagcatttgtaatggccgcgggcgggaaaatggcgccaggttgacacagtaagagattgctacgatccaacagcccatgagcgactttctgcacgtctcccccaacaggtcgaccctgcgatgatccgctatctcacctatgatagctccatctgcctgtcgcactaataaacactctggctctgattaaatcatctcgtatcggaggcgactattgtattgttattttcggcccgaagaacggcgtgcaaagaaggttgctataatttcacaactctacgcactcttattattcttattgactaactccgaataatgaaaaaacaaccccaacggtcgtcgtagaccatagattcctcttattgaggggcttatcttgttattggttgcccttgtgcatctattgcgggcctccctccttggaacatgctcagctcttggcttgactgtacatgtatgtacacactgtatgtaccttgctcctcccctcccccgccaccgcttaactccattgcttccggcatttgaccattgatcacatgaccaccacaagtcttatttcaactgccggttgttttgttgtttgttttttccccccaaaaaaccctcaccctccactccaccacacccctccacttcccccactgtctatcaatcggaagtttgccttaactaaacttttaggggtctcgttgccagtctaaactaaaagtagtctgtctttgcactgtaccacgtggaacaatgagacgcacggtcgcaggtcgtatttgacgaagacttgtcgacttggtttaaacgagcaaatgtgacttccgaaacgtttttaacccgaatgaaaatcagcacaaggttgaaagcttggtttccaaatctccgaggctgtggcagagccgagagaatctgacacaggcgtgcagacgttatgagagttacacggttggattggtctggccccggcgagtccgccaataccatttgtgcacacccttgcagtcaagcatggccaacatgtctccttctcacccccctcccctcccccctgcccccaacctactccactcaagcacatatcctgtaggaacagcatttctcgcttatgctggccgacacaaagaaccgccggggcttctgcacgctcatgtgaaatcgtctccggcctcgattgcgctctagatccgcttgcgaagtaccgaattcctgccgaagtgggaataactggttttcataactgctggtttattccagttggaacctgcacaacaaagaagaaggatcgtcgcaataccctccggaaccatgttttatctcgctcttggcacttttcctgcatttccttccccccatgtccacagactcattccagcgaacacttatcctgcccgtcaatagctagcagaaggttctgctcgggatatgaaaacgctacccacggagatcttgctctagaactccggcagacctctgtacactgttccaattcaggaagttcaatccacaatgtactggttgctatggaatgacgtcagaaagctgtctcaaggcgttatggcaccgaaagagtctcacagagatggcccaggggcatgtagaggaataagtgccaccctgaatacgcgcggaacaagcggaatagattcaaactccactttaatgctccgtggggagcatgaccggtcgtattgcttgtacttgtctcaggaagggcgggtataataacgataactgagtcggaggaatgaactcgatacgatctgagatacgggactcaaacagagccaatctacaagccaaggcggttatcaggatcggtctcctcgcagatagagcttcgtttgtggtggacagttatgagttttttagaaaacatgaattccagggcaagtttctgatgcagaccactggtgaacgaaaatgagggcttattacaatcgcaaacgttggacaatcacagcagtgaacttctcttgtttgtatctcttctgtaacaaaagctagcatcacttttctacctctccatgacagcaagagacgaagatataaaacaatacaagccagttgcgatcatggagagttctttattctctttatcgtcctacattatcctttgaaacttcttatccctgaacctcaaccccttacctccatttctttcacctcaccccctgttgaacctcatattggtttctggcattcttaccaacaatgatggcggattgaagtgtctacttgtagttaagcaagtctaaataataaaccgacaattgtatctgatctgcccgaacctccttgtgctctaagcgcgatactcattagtacagccctgcgatgagtccaaactagccttgtggttgcccacaaagcaccttttttgtctctagtttgcattaccggacacgaagaaaccctaccatgggctaaatactgctctctgtgggcccacaagtactgtctagcacttccacggagatgatcacaaatatgcaggtgctagcgtcgttcaggtcatttttcagcactagtgccaaaataaaccccagcgttccatctccgccatccagaagcgcactaattcaaggggaaggaataccaacaacagttagtcaagtgtttatttttgtccgaacaacgctgaagaagttgtcaaggttgtcttcatgtgcagcggcgagaggaaagagggtccaaccaactctctcggtgacctgacgaatacgaggagttgatcactgcattctttaggccccaaggaatatatcaatgcagtatatgtgactgtagactcccgtattcgataattaccacgttggtattggtgggtgggtgtctcgcctgattcatcagagaacagtttagaaagtgaagaaatgaagtgctgttaatgcatgtattaacaaacggagttgacccgtgaactcgcggcaaaaaactgaacaaggacgacatgttttccccataatactttgttatctaccccagttagctgaatcctacaagtagtagaccctagggtgggtacactgagacagtggagggcaatattttaattcaaaagtcggaggttttttgagaccctcttttgttcaggtcatgtgacccgtattttgaagtccctgcttagctcctattcctcagattcttgtggtacactcgaacccatacgagcactttatgccatacattgggggagctgcgcttatgtaagcataggagttttattttcatttttattttcatttttatttcagttttttgatagtggatgttatttggcaagtagcacgctatactggtggctacgtccaatatcgactcctccaggtccggttttatcacgtgaatgtcacgtgattactcataccggtactgtactgtacagtactgcactcgtagtgcatctgagctggaccgttggatttcaagttaccctactttttcccccacatgtgtttttccgttgtgattttgagcctcggtaaatggggaactttgattccggcgctgggaaatggggaggtgcacttatctcgacttttcgggctctgatttggaaaaggacaactgatttgaattcagcagatttttcttaacattgcggtagtttcaaaaatcaaaaatacccactttccaagtaattccacgtctcatctatcatcttggaccctaaccctgaaaacgcaccccacatcagctcctctcatgattccctcttgtctctctacacaacacatggcacctcgagaagatctagtgcaaagtgcggtggcgttcctgaacgatcctcaggcagccactgccccgctcgccaagcggatcgagtttctggagtccaaggatatgactcctgaggagattgaggaggctctcaagcgggctggatcgggctcggcccaaagtcatcctggaagtgtggtgagtcacgggggcgctgctccaaccgtgcctgcctcctatgcattccaatcggctcctcctcttcctgaacgggattggaaggatgtattcatcatggccaccgtcactgttggtgttggatttggcctgtacacggtggcaaagcgatacctgatgcctctcatcctgccccccacccctccgtctctcgaggccgacaaggaggctctggaagcggagtttgcccgtgtgcagggcctgctcgaccaggtgcagcaggacacagaggaggtcaagaacagccaggtagaggtggccaagcgggtcacagacgcgctcaagggcgtggaggagaccatcgaccagctcaaatcgcagaccaagaagcgtgacgacgagatgaagcttgtgaccgccgaggtggagcgaatcagagacagactgcccaagaacattgacaagctcaaggattcgcaggaacagggtctggccgacattcagagcgagctcaagtcgctcaagcagctgctcagcacccgaaccgcagccagctctggacccaagctgcctcccattcctcctccctcctcctacctcactcgaaaggcgtctcctgccgttccagctgctgctcccgcacctgtgactcccggctctcccgtgcacaatgtgtcttcaagcagcaccgttcctgctgaccgagacgactttatccccactcccgcaggagctgtgcctatgattccccagcctgcttccatgtcctcttcgagcacctctaccgtgcccaactcggccatttccagcgccccctcccccatccaggagccagagccttttgtgcccgagcccggcaacagcgccgtgaagaagcccgcccccaaggctagcattcccgcctggcagttggctgccttggaaaaggaaaaggaaaaggaaaaggagtaaatgttaggatacagtgatgatagtgcagagatgacgtgatgaaatgccgaaatcgaacagtgaacggtagctcaccttcgagtgttcggttggaccatggatcagacggtgttcatggtgtactaggatgtataaggtggatctttatgttagtgcaggcatatagaggaatttatttaatgctactgtagtggtaagacgtgatcaatttttttttgacgtgataaattttttgagctattctgcactactctactaggggacatagatgctcgggacatttctccattctgacgaccattattggtacctagactgatatcgtggagcatcaaatccgttttgggctgatttgaacaagtcggtgccgatattgccacgcctgtgaatagtatatagaactaggcagctcttcctgtttagcctgaatccgaagtcggagcggcaagatcaagtcgagagaccgtgtcacgattctggaaagaatttcgcgttcggacttctcagagaagtgatgcaagatggctcagatcaaagacagaggattcacttaaaggcgcttggttgaataacatgacgttactactgacaaactccaaatgctctacttccgtagtcagagacagaactgggtatagtacagtatgtattgcgtagtatgtaccgtactgttttggacaggcccagtttggaaaacacacgggttaccgttagccaaagcccgttaaaagtgtcgattgaaggtctgttggaattatcaccaacaacctgtcttgtgtttcgggcatttccccggtcttacgccttggaccgccatgatgagggaactccgctcctagagagatgtacgatggctttccacaggggacctggcagagcgcgacggcggtgagatggaaactcgagtgacagtggttacaatctaacttggatgcaagaagatactgtcactggacttcacggccattgtggttcccctttgtgaaaaattattcatgtcagcatcatgcgataggtgcgactgagaaacacgttttgttatgagagtctaggacgtggagacgacctgagagagtgagggagtctaggatctggagacaaccagggatttcagggagtcatacattagatgatgacatatgtcgtcaagtgaacccgaggttctcataccgtcctactgtacttgtacttagttcaatctatcctgaacaagttattaatcaggttacgaggagggagtcctaatctttagtttcttgacttggatgctccaaaggagtatagtacatacagaataggtcatcagaacttgtactgtaggtctgcttgtctattttatagcaacctagtgttcacaatctcagcatctctaaccagcaatcgcataggtgaagttgacatgacgagacacaccaccacctttcagtaagtacagtatgtacacttgtagtgattggtaaaagttgtagaccacgcaaattcataagatatgctcgaatcaggcccaagagttggttcctcgtaaaccgggcgtcgttggtgaactcttggtgaactcttatgttttgtttttttgacccatctgacttggcacacacatatgctccttgttttggtcacgtacaagtgctgtacttgtatgacgacgttgtgaagaaacacacaaagcagtgaggtcaaataatgacaaacacgtgaaactgagctcatgtagacgcgtttcatacattcacgtgaccgataaccgtcatctggttggacggcggaaatgttgtaacattgatcgccggatgtctcacgagatcttggcacggcactgataatgcacgacgcaatgtcggactccgaagattgtctgggggatggaagggtgaagtcaggagagcggtaacgaacaaaatgaccgcaaaaccagagactccgaatgaaagttgcacgttcagaccgaccacgtggtctgatcttctcaactcaactcattccgtaacccccgcccctataccaggagtggcttgatcaaactcgaggaagacagttggatacacatcacttcaccagaccaccaccaccatgacaatcacagatctccactcgttgggtgaattcgaggaggccatcaagtcagaagaactgacggtaatcaagttctcgacaaagacatgcataccatgcaaaatgattgcccccgtttatgaaaagtactccaaggcttacaaaggagcgaagtactacaattgcgactctgaagagctcgtggaagtggcttccatggtacccgtcagctctgtacccaccttcgcgctctacaagaatggtgaaatcgtgctcattgtgtctggcaatggagctgaccctcggaagctgagaagtgggatccgaaagtatgccgccaaagatgagaccaagaagcctcgtcctgtgactaacggaatcaagaagagacgtagacccaagaagataacttgatttatcgctgacccggtcaaatctcagggtccgtcattattaatcaattgatggtctccctggttacttctccctacagtgttgtaatacacagctaaattgtggcagtcggaaaggccgccctaggccaatgtaatgagagtcaaggccctaatccgtaccgatgagagcgtattgaagggcaccagatcacaaatccacacaatcgatccacattcggtactttgatgactttcacagtctccagggcggtctctgggtgatgaacaaggtctaaactaatcagttggaaactcctaaccataaggagcctcttttatttaaacaaaatgtagacagcagcagcagtcataacatcgcactgaacgagaaatggagagactgaacgaggcaaaataactgacgctttcaatttatcggctttaaccggaaaaatgactatcttttctagatttgtcatcatcattagatctagacccaaaaaatcaccatatcgcttcgattcagttcaaagaggacataatctcatgacagacaactcgcccttcggaatacaatcatcctctccaaatgacatgaaagagtccctttttctctgtgcttgtaacacatgctataatccaacatcatcataatttttcaccccgattgcgattaagttcggtcggagctaaatatttttatgcgtctaattttatttttgaaaatttcgtttttcatgaaacgactcttcaccagcatgaataccagcattgtgcgattgaaaactgcaagcatccagtttgacaagagtccacgggcacgtcaaccgtcgatttccgactcggagactctcgaggctctcaaacacgcctcccatgtgctgcaaaccacccatgagcccgtggcgttccctacagagacggtgtacggactaggagccagtgctctgagcacagagtcggtcaagagcatttatgctgcgaaaaatcgacctgccgacaaccctctgattgtgcatgtttcgtcattggatcagctgaagcgcaagattctcaagggccgagagattcccgacgtttacacgccgctgattgaaaagttctggcctggtcctctaacgattttgcttccgcttgactcggacagcgatgtatcgcctgcctgtaccgttggtcagcccacagttgctgttcgaatgccagatcatccagtggcacgctccctgattgctctcagtgacttgcctctggccgctccctccgccaatgcgtctactcgaccgtctcccacaactgcggaccatgtttaccatgacttgcagggccgaattccgctcattctggacggaggcgcctgtcatgtgggtgttgaatcgacggtggtggacggtctctctgatcctcctatgctgctgcgacctggaggagtcagtctggagcagattagagaacatggaggcgaaaagtggaagaatgttcttgtgggacgagcaaatgcaaagactgacgaggccgtgcggactccaggcatgaaatacaagcattactcaccaactggaaaggtggttctgtttggacctgtgagcgacaagtctgtggagcaggccgtgaaggagtacgtgacgagtggagaattggagggaaagaagattggactgttgacgtcactcactctgtctaatgacacgctccctgacgttcacaccctcagtatgggcaccactcctgccctggtgagccgaaacctgtttgccggacttcgagatatggacattgcggaagtcgaggtgattttggtggagggaattagagaggaggatgaggggctggcggtgatgaatcgactaagaaaggctgcatccgaggaaatcaccgtctaacggaaccaaaggccatatatgtctgagcgaacgactaaagatgcaagccttgactacaacttccagaaagctgcgttaagcaaggaaactatcaactttcaaggccgaagcaatccagggaatgagtgagagctcaccagcgaacaatgagaagaagaccctgtcacaaacatacagctcactgtaacatgcccacaatagtatgtacagtatgtacttactctacagctacccctggtgatgactagtatatagataatttattaatgactgacgagatgagaccactgcagaagacactgcaggccacattcgcaagaatacaaaaagatgcttgccatttggtacacccacacctactcttactctagtctaaatgtatccattaattatcatatcctccctcgcttacccaggtccactctgggctcatgctatattacaatgtctctgtgcctcgcctagaccacactgttggtgtagttatttgtactacgcgacttcaaaaagtactttttggcctcgtcgagaatccacacagaggacgaaatgagcaccagcgacagcagatccttcaccgacagagcctccgtctggaacacgctctgaaggaagggcacatacaccactgccagctggccaatgatcgatgctccacaggcgtacaggaacatcttgttagagaagaagccaatctcaaacacggacttggtggcagatcggcaggccagggcgttgaacatgtcgtagaagacgaaacaagtgaaagtcatagtggtgtctcgcttgtcgatgacgccgtcctgcatctgcgtgacgtagacaagcattgtaccgactagaatgatgacggcggcctccacacatttcttaaccagatcgggggtcatgaccttctcgtttcgaggtcggggaggcttgttcatcacgtcaggatccacgggctcaactcccagagattgggcaggaggaccgtccatgagaatattgatccacagaatctgcatgggattgagggggttctccagacccataatggtagccacggcgacaattgacagagcggccatggatgtcgacagctggaaggtgatgaagtttcgaatgttgttaaaaatacccttaccttcctcgatggccgacagaatggtagcgaaatcgtcgtcagtcagaatcatgtcggcagcctccttggccacatctgttcctccctggcccatggcaatgccgatatcggcaagcttgagggcaggggcatcgttgacaccgtctccagtcatggcaaccacatcacctcgtcgttggaagcccttgacaatcttcatcttgtcctcgggagaggttcgagcgaaaatagacgcggtttggagacactcatcaagagcctggtcggacatggtggccagtttgcttccctcaaccacagattgagtcccaggcatcagaggcattccgattcgtcgaccaatggaaagagcggtggcagcagagtctccagtgatcataacgactcggactccaccagttgtgagtcgtcggatggctcgaggcacatcgggtcgaggaggatcgtagagacccatgagaccagcaaacacaagaccctcaggggcctcctcggagccctcctcgtacttgccctgcttgtaggcgaaggcaatgattcggagaccatcgttagacatttccgacgcaatttcggtcactttctttcgcatgtcgtcgttgaagggggcggtcttaccgtccttcttgcagtagtactcgcagaaaggagcaatgacctctccggcacccttgacagagatcatgggggtggaggagtcgcccgtggtggtggaggtgagcatccactttcgagaagacgaaaagggaacctcagcgactcgctttcgggtctctcgggtatcctcgagtccaaagtaatccaggacctcaatcagagcaatgtccgtagcgtttccaaccaggtggccagcttctcgattgaacttactgttgttacacaggttgccgaccttgagcatgtttgcaagggaaacagagttcttgagagcagccacagccttgggatcagcctcggtatgggactggccaggctttagggtaacagcgttagcgagatctcccatgtcgacggtccagcaggttgtgcaggacatgtggtttcgtgtgagggttcctgtcttatcggagcagatgacgttaacagagcccagggtctcgacagagggcagttttcgcacaatggccttctgtcgcgacattcgcagaactcctagagccagggtcacagtaacaatgatgggcagaccttcgggaatggcggcgacagctagagagacaccaatggtgaacatctccagccaatctcggccctggaacataccaatcagacagataacaccaatgacaccgaacgaaaccagggacaggtcctttcctaggttgtccatgctggcttggaggggagtcttgggggtggagatttcagacaccatgtcatagacggctccaaaggcggtgtgggagcctgttcctaccacgattccagttccgtttccgtctctaaccaaggtgcccatgtatgcggtattggttcgatctgcgaggccgatggggggagtgcctgtgactgggtttgtgtccttggtgacgggcgtagtttctccagtgaggttggactcgtcgatagacaggtggacggccttgacgattcggcaatcggccgggattcgatctccgacggagaattcgacgagatctccgggcaccagggtcgaggccagaacggtctggctgttacctgctcggatgagatgggcttcggggggcacgagcttgttgagggcctccagcgatttttcggaccggtactcctgcacaaagccaacggtggtgacaatgagaatggccagggtgatggagatggcgtcgtcgtggttgcccatgaagaaggacaccgccgcggcgccaatcagcagcagcagcagcgggttttcggaaaactgctcaaaaaactttttgatgagcgagtcctcctcctcctgtgcaaactcgttgctgccgtgaatgtctcgccggtgcatggcttcttggctggacgtgaggcccgtctcggggttggtctgcagcttggaacacgtttcttccaccgtcatttggcaatattgcgcgctgggcgtggcgtgcgagcggttgttggtctccgacagaggcacgccctccgtgcttgtgtggctgtccatcttgtcaggggatgtgtgtgcggttgaggtggtggtggtaggagggagagggtggttcaagctgtttggcagatgctgatgagcaccacgtagctttaatgtgagactaagttttagctgtgacggaggacaagtagaggagagcggcgtgaatcggcgtgaaacaggtggcgatttgggcgcagacgctgtgtggtggtcggtggtctcatttggagctcggtcggccgcgaatcccccggtttttgctacccccaagccgggttttgctcgcccctaccttctcacttgctacttgacttgcaccactggctgggggtcttctacgcgtctaccaggcacgcactggcaggttaggacagggccagaatcccgggcgtaaaatatccatgtgcgatagggaccaccagaatatacgcgggaaaacggcggcctgactactggcattgagcgcccgaatctcatcaaaccacatgccctgaccaagggggctatgccatcgtataattgtatactttaaccatactactgctgtacatacagtacacggaatcgccaggactgaaccatgaatgaatcatacggcaccggagcacctggagcggttgtgctcgtagagtgggacgtgttgtagggccgaaggatgcaacttgggcattgtattatctgtctgcgtcttatctctgttaatattacgcattccggtacggttcgacgtacactaccgccatcacttgcacctccactcgtctggctgcctactttaaacacctcctaccctcctaccctcctaccctccatctccaaccaccgcagtctcgacgggaaagacacaagcagcagttgattacaccggtcacccgctactcttgcgctagcaaagagccaaatacctcagctcacatggacggcattgtggctatgctatcagccgtgccctgtatcaccggtcagacagtacatatacatctcagttttggacctttgccaatttccgggaaatcggacggtttggcggtgtcacaacacactggttgcaacacgtccgattactgcacagatacttagtccctctcactggcaacatccagtcccctccacccattgtaccgactcgtacttaggcaggttgctgaagtcagacgagcttattcggacttgaccggacaattgagcgacatgaaactcggtatattcgtgagataccgtcgcggtattattacataatcgtgtgctgcggccccgattatccccattgcaacagtctccgcccccttttcgctccgccaacccccagaaactaccccctccgccgaccactcctcgtcagtaaactccaatttaggctggaaaaaaaaatccttagtccggtttttatttcttagctggggaaggtggcagtgctgagcttgagccaaaaaaaataaaaatgagtcaaataatctgagcgaaatgtcagctcaagtgccatgttggaggcgtctttccgtgggcaaaaaacgccgcttttcgtgtatttcaacccgggtcgcctcccgaaccgctcccgccacccttccatggactctacacgccggtttcctcttgctgggtcgcgtgatggacgaacttaatggagacagaaagagccagcacccaaatcaccccaatcgcccaaatcacccaaatcaacccaaaaccaatgtccccgatttcatttgctgccagtccacgggacctgaactacggtacttgttactgcataggtggacagaaacccggggttcgtggtgctaatgaacgcgagcttagtaagcgttggtagttggtggtacgagtagctacagagtactctctacccacccatccaatgcagctgagctcatacagacattagagaaggctgctcaagaaagacagaagagaacggtgtcttatatacatggtcaccaaccaatatgaggcaccctctgatgaccgtcaattcactgattacaactcagttctagcaattgtggtaagagtcggatcggtctggtcaagagtactggcacagcacaggttcttgaagttaccgttgtaatcttcggattggtgtcgtacatgagtacaggcaccgtatggactattattactcatctatgatgtctttagaacccttgtcattgacatagacccgtcggagtaactattgtactagttgcactatcaaggtctctgcgacgagggtcattagatgttttaacccgttaccggatgaaaagtcaagccttggacacactctcaacgtttgatataccgccatattctctctgtcggacggagactggtctggaggctctttttcacattcgagagagcgagagagttgagcgacatccagcccacagctacgccactgcagagagagattacgagaagacagagaccgtcgtaactaatgtcaccagcgccagacaatactagcagttccaggtcttcaccgtcattgaaacagcaacttgtgtcaccggagcccaagtctcagggtagcaatgtgttaatacggtatcgaccctagagtttgaagtgtaaagctgccactgaagagacctttgttaacgactagctagatgtcttcgatcataatactgccaatgtggacgaggcgcgaaggctgcgtaattagctggtgaagtgccgagcggtgtagttggtgcaagttctatctggctgacgaccgtcactactccagtacatagtgttctactcctgttgctctacttgtactactactccaatgctatattacaatcatcaattaaaacatatttacaacaaaatcccgtttgttcctcctcggcctgttcagcgtgtgtggcgtttactgaacaggacccatgaccatggcgagcagagccattcggacaaagagtccgtgtcgcatctgtcggaagtaggcggctcgggcatcaaagtcgacctcggggttgatttcggcatttcgaggcagaggatgcatgacacacatgtggggcttggcgtccttgagcaccttgttgtcgaccaagtacgactccttgatggcctcaaactccttctcgttagtgaatcgctccttctgtactcgagtgcagtagagaacatcagtcgtggagacaatctcgggggtgagcgtggcggactcaagatcgagcttgccctgagacttgagaagagtcttgagctcgtcgggcagagtgagctcggggggacacaccagtcgaatgttgaccttgtagtgggtcagcagacgcaccagagagtgcacggttcggccgtaccgcagatcacccatgaaggtgatggtggtgccgttgagagtaccaacctcctctcggatggtgtacatgtcgagaagagcctgggtggggtgctcgacggatccattgccaccgttgatgacggggacaggagagaatcggccggcgatgttggcagactcggggtcggggtgtcgcagagcgatggcgtccgagtagcaagcaacagatcggagagtgtcctgcagggtctcgcccttcttgtaggaggaggcgtcgacgttgacggcaatgacacggcctccaagtcgctgcatggcggcatcaaaggaagtggcggttcgggtggaaggctcgtagaagagggtggtcagcagacgacccttgaggatgtccagaacaccgactcgcttgacagcctgtcgcagctcgttggccagagcaaaaatgtcgtgcaggttctccttggagaactggttgacagagagaatgtgctgaccaaggaaggggtttcgtcgcagcttgttgagaatggaaggagcggaaacctcgggggggatggcaccgacaacagacgactcaacgtggttgttagcgaagggtcgaacgtcggaggagaatgagaatcgggccattcggggggtggtgggggagtgcaccatctcctgggtggcaggagcagcctcaacgggagcagcctgggggtggatggagatggccttgccggtggaagcaccgttgaggtcaccctcaaggacaacagtctgtccgccgacaatgactcgctcaacggagccagtggcaggcttgccggccatgggagaccacagacccttggacttgaaagtgtactttcggccgaggttgacgacaatggaggtgtcgggctgctccaccagctcgaagattcgaacggggttggtgtagagccgagcctcaatgtcctcgacggtgagacgcttgtcagccacggcagagagcagcagaggcagggtctcggcaacaccaagaccagcgacaacgggctggccgagctccttggccatctgagaaggcagaatgccgacggagaagcagtcgatggtggcaaggttggcccacagagcatcctggtcctcctgggtgggcagagagtgggcctcggggtagtcctctcgggcaaagaagagggcaaagacggacacgtcacaggtgacagccagacctcgctccttggccatggcaaccagcacaatgtcgttcttgtcaacaacgccggtcacgtggatgggccggttgtgcagggaagccagcagcagaatggaggccaggtcggtggtggtggcgtcagtgacaatgggcttgttggcgggccaggcgccaaagtgctccgagatggcagccaccttggtggtgttgtcgcccagcttgctgaagggcagcaccagagaaccaaccttgccggtcaccttaccaacctcgttggcattgtgagcagtggcagccacagaaaggttatagtctgtgaaggagtggccctcggcgttagcctgagcagtctgaagcgaagccagatcgatgatggactcggacacgcccatggggagcagtcgagagaaggtgaagccagatcgcagagacaccttggtgaagtcggcaatgtcggaagagccagcaatggcaatgtcgggaaccacaccggccacgttgaccagaccaggaagagtcacagtgttgtgagacgactggaagtcggtggcggacacgtccagagtcatgtttcgagccagagcctcggtcagcaacttggcgttcttgacgttggtcaccagaggaacggcgtagtcaacagccagacgtcgagttcggtaacccttggacatgtagttggcgggtcgtcggaaccggttggaagagggcaggttgatgtataggtcgatcatgttgttggccaggtgctgagtcagcgagtactcagacttctcctcgtcagcaccctcgttgaggacatcgaggtactggacgggaacgccgtgctcctggatgaagtcggctgtaccggcagtggcaaacagcttgaagccgagctcgtggagtcgcttgatggagggcatcagctcaaccttctccttgtaagaaccaacggacagaagaatgttcttcttgggcagcttgaagccagtggcaagcagagccttgaggtaggcttcgtacttgttcttgccaaaggtagcaacctcaccagtggaggccatctcgacaccgaggatggggtcagctccagacagtcgagagaaggagaactggggcaccttgacggcgacaaagtcctgggggagctcctccagggggtaaggagagactgggaaaccgcagatagccttggtggccatctcaatgagatcaacaccggtcaccttggacacgaaggggaaagatcgagaggctcgcacgttgcactcaatgaccttgatttcgttgtccttggcaatgaactgaatgttgaagggaccagtcacctgcagagccttaccaatcttggcggtggccacgacaatacgtcggacagtctcgggatcgagatcctggggaggcacaatcagagtggcatctccagagtgcacaccagcgttctcaacgtgctcggaaacaacgtgcatgatgagcttaccgtccttggcaacagcgtccatctcaatctccttggcgttctcaatgtacttggtgatgacgacagggtagtctcgagacacttcgacagcctggttgaggtaagaggccagatcgtctcgggtgtagacggtgttcatggcggcaccagaaagcacgtaagaaggtcgcacaagcacagggtaagagaccttctcggcaaaggcctcggcctcgtcgatggaggtcaactccttccaggcaggctggtcaacctcaatggtgtccagcattcgggagaacttgtatcggttctcggcagagtcgatcatctcaggagaagtaccgagaatgttgacgttctgtcggtacagctgcagagcaatgttgttggaggtctgaccacccatggagatgacgacaccggaggatcgctccagctcgtaaatgtcgaggattcgctccatgttgatgacctcaaagtagagtcggtcggcctcgtcgtagtcggtagacacagtctcggggttgtagttgaccatgatggttttggcgccctgttctcgaagagttcggacggctcgaacagcacaccagtcaaactcgacggaagagccgattcggtagacaccagaaccaaggaccatggtgccgtgatcgtcaaaggtcagatcgtgggagtcagcgttgtaggtcatgtaaaggtagttggtgaaggcggggaactcagcagcaacggtatcaatctgcttgacgaaaggggtgacaccagcctcgactcgcttgagacgcacagccagctcgttggagccggtgtacttggcaatctgtcgatcgtcgaaacccagctgcttggcctctcgcatgatgttgacaggcaggttggagttgttgtacttggtcaggcccttggcgaacttgaccagaccgtccagcttgttaaggaaccacttgtcgatgttggtgagctcccagatcttgtccacggtgtaaccagagtgcagagcgttggcaattgcgaacagtcgctgatcagaaggagtctgcagctcggagtcaatgtcgatcgacatgagagcctcggtctcgttgaaacccaggttctggtagtcagtggaccggatggccttctggatggcctcctcaaaggttcgaccgatagacatgacctctccgacggacttcatggcggaagacagcagagtagacacacgggtgaatttcttgagatcccatcgaggaatcttgacaacaacataatccagagagggctcgaaacaggcacaggtgacctgggtgacggagtttcgaatctcgttcaggggaatgttgagaccaagcttggcagcgatgaatgccagggggtagccggtggccttggaagccagggcagaagatcgagacagacgggcgttgacctcaatgatgcaatactccttgctgaaggggttgagggcgtactggatgttacactcaccaaccacaccgagatgtcggatgacgttgacagcggtggttcgcagcatgttgtagtcctcatcagacagggtctgagagggggccacgacgatggagtcaccagtgtggataccgagagggtcgaagttctccatgttacacacagtgatacagttgtcaaaggcatctcgaacaacctcgtactcaatctccttccagcccttcatggatcgctcgaccaggatctgaggtgagccggcaaacgccttgttacacagctcgatcagctcggcttcgttgtcggcaaaaccggaacctagaccaccaagagcgtaggcagctcgaacgataacagggtagccaatctcctcaacgacagcaagagcctcttccttggaagaagcagtggccgacttggcgcacttctcgccaatctcctccatggatcgggcaaacagctctcggtcctcggtggtgatgacggtgtcgatgggggtaccgagcaccttgacaccgagaccctcaaactcgtccttcatctcgataccaacgttgagagcggtctggccaccaaaggtgacgtagatggcgtcggggcgctcgtacttgatcacctttcgcacaaactcgggggtcacaggcaggaagtacaccttgtcggccagacccttggaggtttggatggtggcaatgttggggttgataagcacggtgtagatgccctcctccttgagagccttgatggcctgagaaccggagtagtcgaactcaccagcctggccaatggagagacctccagagcccaaaacaagcaccttcttgacctgcactcgggggtgagcggctcggttctcctcaatggtgccaccggggaactcgatggccttgagaacaccagaggtcttgtgctcgacgacagccttgatgaaaacgtcaaacaggaactcggtgtctcggggaccgggggtggactcggggtggaactgcaccgagaagaagggcaggtccttgtgatagataccctcgttggagccgtcgttggagttgacaaaaagctcctcccagccgccagtcagagacttggcgtccacagcgtaaccgtggttctgcgaggtgatgtagcatcgaccagacagcaagttggtgcagggaatgttgtgtcctcggttaccgaacttcatcttgagagtggtggcgccggtagatcgagaaagcagctggtgaccaagacagataccaaagatgggggtcttcttggcctcgacggccttggcgattcgagcggcggtttccttgagcacggagggatctccgggaccgttggagaggaagagaccgtcgtactcctcgttgaggaagtcgtagtcgtaagggacgaccagaagctcgacgcctcggttgacaaagcatcggatctggttgtacttcataccaacgtcgacagccaggattcgaacaggcttgccgttgacgtgaatagctcggtcagcaggaggggtgtagagcttgggctccttgatggaaacctcggcgaccaggttgagcttgttagggtcgacccactcagggaccgcgttgtcaatgcacagtcgtccgagcatggaaccctcctctcggatgtgcttggtcattcgtcgggtgtcgacgccgtagatggcaggaatgtcctgctccttgagccaggcaccgagagaagattcggccaggaagtgcgagtactcctcggtgtacgaggcaacaacaagacccgccacatggatcttgttgctctcaaagtgcttggggaggcccttgaccacttcgtccacggcctctcgagaggggacaccgtagttgccgaccagggggaaggtgacaatcagaatctgaccctggtaggagggatcggtgatggactcgggatagcccaccataccggtttggaacacgagctcgcccgccacaggcttgtcggctccgaaagagtaaccctgaacggcagtgccgtcttgaagctccagggtcatgagcttgtcctcggggttgaggggggggaagatgggaagcgagggggtcattctgggttagtatgatcgaacggagtgtgatcgtgtgctacggtgacgtctagagagcacaggaactgactgtatcttcaacatcgatcgatcgcggcgtcatgcagaagccgtggttttggtggatcgggcagagtcgcagcgtttttgtcgtctctcaaaaataccaatactaactactgaggatgagaatgggtagcaaaagacattcggtgtgttgagggtgtgtgtgtggtgtagttgtagagtgtgaagtgcaagctcagaccatcagtagggttgcagagaagcagcagcagcactacgctaccaacagcaccattgacgttactccagcatccccacaaccaccacagatcacatgtatctgcaatggtcgatggcaggacagcagctcacccgtcggtcagtagcagcagctcagctcttcagcagccgttcagcattcagcagccgttcagcacttcagcacttcagtagctgcaacatggcagtaaactgcatacgtgggactacaagactgacgacatgtagggcactgcacatctaaataatgcaccccacaggaccccagccattaccaccaccccacacactgggccccagactcagacaagcgtccgtccaccgttgtttccttccatccgtctcaatctctcaatcgtcttcactcactcacttttactcctttgctacacctgccgaataggacaaaagatttcgtgaggaagagagagagagagaggagaggagagagaaggagacacatgggtgttcctcgcctatataaatatcgaggccaatgaaaaaatttataacctcaaggtttgggtgcataaagaggactttgggaccttaccctggggggagttgggggtggaaatagtgtgatgaggagcctggaattttgacagatggtctataagagtgtcaattatctgtcatctttttttccgcgcgattcggccactattgggtcctccagattcctttcgaatgtcgccacttctccacctaacgaaccttgtcagaagccgaaggccgaacagcacggttaaaagccccatttccagagcaaaaagcgaccgtttctgcccggaaatcggactcacgtgacccattctgtacaattgacgcccaatctcctggaaaaacggcgtatatccgcgagaaataccgacctattctcggtggcaactgtcgctatactgtcagtcagggaaaaaaaggccgattgaaataaaaagaaccttaacgctaaaaacaaaaaaaaattggaaacagtccgagtcataattggaccctgagaaagacatgagtgggtgggaaaggggtcttaaagggctccttgggggccgatttcggaaacgaaaaatgcacgatcccatttcttcgggctacatgaccacttttcgagcgtcttatctcgtttccaccctccccacaacccacattagccaccagtagcacctcccaacctcgtctccatggcacatttcgaacccaaatcaattttttttccacacgatgcatgaacgaggtacgcggctggtgattgagatggcagcggcggaaaacggtgcaaaaaaaaaccgtgtgtgtaaaaagaaacgagacgttgaaaggtgcaattgatgaggcgaacacccacttggctgttttgtcggtcgttacggtagttgcgtggaccatccacgtcgtgatgttggtctgggttgtccatcatcgcccattactcggccatccaagtgtcttaacaaaatatgtgcagtgactgtgaagtcgcttcttgtctgaatgcggtcacacgacggatcgcatcgcacagttgctgaaaaagataagctcaggtgggtctcatggagagtgtgggggttttgggcccaatagtgatccgattttggatctgaaacgtgcattttgttcgtcccatcgataccatcacaatggtatgcgttttgttgctatatcttctatttcaagcaaaatggctggacctctctatcctcctctgcctacactacagactgtacagggcatactgcacccaacatgtgcagcggctaaatggagttaccgagggcttcggcggggtaccggtgctgtagacctgtgtcgagatgtgtggagaatatgatggttttgttcgcctcgtttttggcctgttttttccctcttttactgcgactctttcgctcgtcgttttgctcaccgacatcctacaaccctaactcgagaccggagcaggatacccgaaatatgcaccagagaagccggggctccttgtatcactacccgagtagcttggctacagatgttgatgcgaagcatgggcatgggctaactgcgggctatcgctatccagttggtgaggttcattgctgcccagcgacgtgacacagtggccaagatgaagttgggtgggctctagggaggaccgtagtgcagccttcaagccaactccgggagcaatgttgagaatccggacatgcaaatgattcattcggtcaattaacatgctttcccgcgatctttggtaggtttccatgcctggtttggtgactcagcattggagaagtaccagcatggataatgtgagtttgaggggtaattgaaaagaccaatggtggagatgttcatttgatgattcggatattgtgtgatctcatcatacgttgaaggtcattactgcgtactgtactgtagttgtagttgtagatcatcattgccggacccatgatcagaacctagacaccactttagaaccatggaacgacgtccacaaaggctgagactcgggaaatcgcatattttctgtttcgtaatggccgaaaacatctcagtattcttcatctcgctctctcggcgaaatatccgcttcccgtttggtccttgcgttaataaaactccgagaaaaaacgctgcaagtctctcagtctcgatttggacgggtgaaatattggttaggtgccgttgctggttagagacggattggttggtgacaagttgcgtgcaaatccagtagagcatgacgtttctcgccaattcactgtgtttttgctgactaaattggatgggtatacatgatagatgatgttccgttatgactaagcagcctggaggcgagatgtgtccagtgactatatggcggtatgtacttgtacttgtaccaggcttaatgaactcgtgagggtatccttgaatgacgacaacagaggcatgaatagacagcggagagtggatggaatatcgtccaataaaggagcgggtgggaagagaatcttgaaactgctcaaagacatgatgaatggtgaggtcggaggtgtgctggtgctgttcatgaccatcagctgtgggttggtcgcgctcgggaatgtaaagggagatcgggtgttacaagtacacaatcaccataacaagagtccagtaaaagtctatggacgtgttccgtaggtgtagaaacttgcgcagtactaactgtacttgtactcatactcctcctgcacttgtcaagactcgtatgtccctgtcggttccacccctttgaaaacggaggttcgataaaaccataccaggaccggctctcgatactgtgtgtatcaaaagtcaagtctccgtgtacaatactcggtccaagtccgacaagtgtaactgcacagtgcgtgtctttatcagagcgatctcaccatcagctcctagcagctgtcacactacgactacagagctgagtacagtgtcttgtaccatactccgtcagactagccaatgacagacgtacaattcctttagtacgaggacggtacagtacgtcaagtttgctcggattgggtccttttgaatccgtctcctcctcttggctgcccctcatcagtccacgagttacagtccatgttctggaaatccttcctcatcggtccaagtaccgtaccggacgtaccgaaccgtaccagaatgttccctctggaatgcactctggttgcatcgcagtccgagccgcgtgttctttcctgactcccgggggttcttggcaatacaacacagcaaagaggctccggggttgtctgccaagaggagactttattctcggccgtacgtgttagtttgctacgttcagctcctctggttcgattctctcgtctgtatcttctcctgggtcctacccattgttacaccgtggtccgtccttgctgaaacaatacaacggttgtatagaaacggcggtcatcacgcaagaccatctaatctatgcacgtttgagcaaattggtcgggtctcttgctggcaacaagtctggtttgggaagacccttgtctcaccttgcgcccagcttcatccctcccctcgttccatcccttgtctgcgacgttttgagaccgccaataacttgtggcagattactcaaatttgcccgtctgattggcccccctttcaattgtcttccagcaacctttaccagcttagacttgaataaaaatatttcacggcgattttttaaccgagcgaatactgccacgggagaacgtacaaggcgccgtatctcgcgcaaaaacgggccattcgagccaaaaatggcgctcaatcaactcagcagactccattccatgcacagccagcaacgcaaccaacccacaccacctccacacctcgctacaggggggcaccccatttatccacgtcatgcatagaggcatatgcatctccatcagatggtccgtttgataactggaaactggagaagtagtggcgtaaataggaaaatacctatatcggaggactcaccaaacaccaacaagtccatcaatctaactttcatcccggaaatcccatcatccaccaaaatacccctcaccgcaaaccctcaccaaactcacacctgcatctaatctaatcaatcagtcaatcttccttcagcaaaaacccgcatggtacaaggccgaatgtgtacggctcgccaagagttcgggaggcggagcagctcccttggcattactaatgcgcatgccattggtgtgggaggggtatctgggccggagtaggcgggacgcaaatatagaccctggaacggaaagaacaagaccattgtaatcgccatcatgtgacaaatccaatggtgcaacttccatctttgtagcttcacatgtcgtcaagttagctccacatgtatgtccataggatgtatctatcatggttgaaactagagctatgaacaggggataaagactattacaagcacctttgagggcatatttcgaatgggtatttgaccagcttatgaccgttttatttccggtccataaaatgcgacaaatgtacgtggttgggtgggttgtttggtcatttgtggacggattttgattttgaaagtaccgtcttgttggaaatcacgtgaggaacacgaatatgctagccattctcggcaatctcttgtcgattccgtgcgcagtttactttgtaatttaactccgtcggatgtaaagagacgtgatagaaccactttgaaaacgttaatggacctcggtttgcataataaacttggccttaaactgtagtttaatttccaaaagggggcgttttgcgcgggatatgggcgcgagagcgcgaatctgagcgcaccagcgtcttctccagccctttgccatcacagccatatgtcgatcgtccacttttggggactccagtggggtcttttggacgcttcaagttggcacggccgaactttaagacgcgcttcttttggtgacaatgaagccccgacacttgcttgaaatatgcccggggttggatattgaaacacatagcagacatttcccgagcgcgcggagtatggagccggtcttggctgtcgaatcccttcactctagcgctgttcagagcccgtcaaaccttttagcctccaaaaagcggaaccaaccgatgcatgttcggatgcaagataatctggcggtccatggggacatggtcacctgtggcccgctccagagccatttgtggccccaaaactcgcaaacggggctcttcactgcaaactccgcccatcagataaagggctctgctccatatgattctcctggatgtcaaagttaaggtggatatttgcgtatgctaaacggagtgatatgtttagcctcccagaatcaatagagttggcgcaacttaaacacaacggagttgtactatgtgtttttgtttgtgttaatttttttctttccttgtgctttttttcttttccttgtgttttttcgcttgtatttttttaatcttttttgccgctatcctaagaggaggggctgagagacgagcaatcggccagagaacccccagagggcgcagagggcgggaaacgaggtcgccgggcgccatatcaccatcacgtgaccccattcccgagagatggcccgtcctccatccaaaccttgccctcgctaaagaatctcaaaccccatcttgtggatgtcaaaaacccacaaaccgtgtggaagcgggtgccaaggttcagcataaaatctagatgccttgcggaagcggatggcggggcgccgaacgggggatatttgtatggcgaccagctgatattattacatcaacgtgtttgcaggcaccacattaccctactggccagtttccagccctctctgaggcctccaacatcctccataagccgcccctaaacctgcctcacaatacaaattaaacatggccaacatgcatgtccatctcaacctagatgaagcatatttcccttgaaatatatatctctggtagcttccgcccccgccaaaatgggttcgatagattatcgctaaagctcacaatgctccacaagttgccgttggaacagctctccactgtgttttccttctgcgacgcgcgttcggtcgtggctctgagtctggtatctccgtacctgcgatcctgtgtccagtccaacagaattgtgtatgaacacgccctcaacgacatttttttcggtctgacaaattcaacaggctctagaaacatgtcggtggctcaatcgctcaacttcatcgcctcgctaggccaccaagtcgacattgagcaagaagtcaacctgctggcagcagaaaagatatccaaaaccacgatagcgccgttccacaacgattacgaactgcacaacaacgtgctggtcaacccaaccgccaccctcgacaactccttgtacaatttcaccaaccccatcacccaaaatgacgactgtctcacctggcttgtcaaggactaccactatgtaaccctttacgaaatgagtctccgcgacggcttcctgcgggtcaagcaccgagaaaacatggaaaacatgattgactacagtggaacttcagtcagcagaagttcgcagatgcaaatcggaagaggtcacctgggccactactacgccaccaacgatacccagattttccaggaccaactgtggatccggaaaaaagagaaccacgtcatcaagtccatcatgttaccgatcggatacaatttgcccggtgtgggggttcagaagctgcagtccagagtcaacagtcggtacagttactgccgcctggactccaaggatgactcagcatggtttctgcttgactggaatcaggccaagtcttttctgctattcaaaaccgacaaatacagcgataagattgatctacatgcctgtgcggaaacaggatgtgtgtttatcacctcaaacacctccctgaacaccctgaagctgttcccacgaatttctgagcgcgaaattacttggtatacagcccagaccaacgatctaccaaagtcatacctgtctctacaatacggatgtgtggttagagaaggagctgaggtgacgtatctcaaacataaggggagtatcttgttggtgggacaggtagagggaactacacagtgctggaagttcacccgtccgtttctctccaagctagatgcctacgtcaagagatgtctgcctgtatggaaagcagatagtgaagaatggagagactggaagatggatctcagtggatacttttatccccaacgaaggagaacgagatagagggatgtatgtattttatttattagaactagttttgcggatagagtacttgtgtttggggtgtagtgtatgatcggagaacaagacgaggccgagttccgtaatttcggggttataagaaaataaaacataccacaatgatcttctcaccttgctggttattacagtaaaggtctcagactgataggggcattatattggttgtttcggcgttttattagggttgatgatggaggctgcgataaaagattagtttgtgtcttggagactcggggagttgacagtttgtcagtaattgttccaattactgctgcattatcctctgcttcaattatttgtcgcatatcctcctgttcattcatgttcctggccacctatatgagtagtcgtcatttccgttctgcaagcttgaccaactccggaagttgcgcatgtgcgtcattggggctgtgcaatttcatcattccgaagcttcaagttgcatggtatttacagctgtattatctggatgatctgttgatggcacctggttcccgagatggtgaattgataagtaaagctgacattgaaggtaagttgctcgttcacgtggttttcagaagtgttatacgaagattgtaaatatatcggtgccgcgtccaaaatgttctccactcaatcgtcttatctacatccccatctaccaaccacacgcaataaacactcagtgagaggctactgcgacataaactcaggcttagaaggcttgattagatcatcgtcgacttgtctgtagcatattagaaagaacctacaagtccttcccacctctttccctaataatgctactcactaatgaacgacggcacgagtacatgtatagcagtcatacgaccgcagagttatgtgtcaagccgcctacttgcagatcatctccatcaagaaccctaaagtgattcgttgaagccttgaagaagcactattagctgctttgagctctcatttctgtccatctacatggtcattcaacctccccacgcccaatagacattcatatgggcgctgttgtctattctatagccagatcggaccctttcatcacccctgatcacctaggttaactttgaaccctcgcagctgattgactgaactcacggactctgagactccaactccaaggggttttagttttttcccctcgagacattcgcccactcggtcacggttcttgcacaagcttcatagacaacatgtttgggttgaggagagaatatgggcgtgatccggttcgttttctgatatataaaacaagccagaagtcatctattgagattcttcatccattgcgacttccagaatctcaattgatccagtattgacagagttagagcaggaacgaattgtatgtttgtcaaaaatggtctagaatagacccccatagacccatatttggtaccattcgaatcctcataatcgtcgtaatctttctagcatactctctcatcaccaaaccccctccccttctgcccatttgtttccacggtcttctcggaactaaaatatcaccccgaaccacccaagaccaacccatgatcaacctgaggcattaagattctcccgaagattggattagtcatccgtaaagggtattaaatatcgtgaatgagtgcaaattcactctctcgaatcatccttattgttctccagtctatctcctgtctgtttctggtcttcctaccacctctcatagtgggtggacaacaactacttagctttacttgaaattactccctttagttgacataaatacactttaaatcacatcatccaactaaactcccaactaaccccgaccactttatttgccggccctaaaacctcttcttcaactcccgaacccaataattaccgtaccgtctccgcttttcgtctcctctcttggtctcctctcttctcttggtctacatctttcctctccaagatatgagatatcacgtgaccgcccaaggcggtaaggcttctgggcgccaagaaacggcgcttctctatatggacgaatgtgcatgtgactccaacagcccatctgcgaatatgagactactccgacgccatactcacaagtggtccatctcgcccaatattggtcagaaaataatttgggcaacagtggcatattcccggagattttctcatcaaaaccataccaaacagcccccactcaggcccctctccgagtgagaacgctcagccacaagtttatcgtcagatgcgttttttttaagcttatttgagcgttctatacggatttgtgggaggtgaaatatgtctacaagtaggccaatagtggacttatttggattctgaaaagagtaatctacttgtccctgcccaagtacatgatttatttttttcagaattcaattggactactccttcatcctcaaccgtatatctccgaaataccgtccgatgcctaatagtttcgtatgtactcccctcatgctctcgcaactttgtcagtcttacaatgggcccctctcttatcatatattaatacccgtcttggcgctgtacaaataaatcactactatactgtcaacttctctaatatctaacaatgtcctacaacacggaggctctggagcgcggacgggcgtttttcaaccgcatgaagcaccaaatgaccattcaaacagataccaccgacaaggaagagtcgacccagcttcaagattcgctagtcaagtactacatgaccaggaacaagaccattccagagtggttggagaccgaggagacccgacagagtctcgaacgacttaagatcaaagatgcctccactgcggcctctaccaatctcgtgactccgacagcccccatccagatcaaaactccggcctccaatgtgcctgaattgacccataggggccgatctcccagtcccaccagtcctcagactcccacttctcctgctttcaccaaccaacggcctcccctcaagtccagaccgtctcagctgcaggatatctacgcccgaagaggctccagtgccgacgtaagccgccagaactctgtcacgggctttgaaaaatacggacgacccaacggttaccaggaagtccgaaacgccagggtcccacctcccttgaaccaggaatcgacagacagaatgagagaaaagcttcgaaacctctcgagaagcaattctgtccaatgccattaggtggtcagtctaatgtaatgtttaatgaagatatgtttataccaaccaggggtggactgtatagtgccagtgttggactttgtagtggataatttcagaccttgtagtggatatgtgtgagattagagtgaatattcgtaattaacagaaagagaagataataatggtacaagtattacgctttatgatgagacttgatttgatctggttgatttttattgctaatgtcaacttggtgtctgtgtgtaaaacccagctgacgtaacaatggaggaggtaaggaaaatggcaagttcaaaactacaataattggagatcaaataatgtagttctccaatcattgtggctctgggatctttgcttcaacacttgcgaaatcatcttcagtttgcaagcctatcaaaaacagtgcagtggctccaaaaagttagcaattaagacgaggacttcaaatgatggtatttccactctttatagatcactatttccccactcaggtctactttcgtcacttaacaccaaattaccctcttgattactaatactcggagatgtcaatactgtgagaaacgtcgatccagaaatcccacacaaaacaagttgaaccaatacataatttcctcctgatattccccttctccaatcacttgttaccacattaataacttctttacatccttctatctgtctcagacattgccgtgcactttggcccgctaagacaccccgaaacgttcccccaccaactttacagtccatcaccgttgttcacgtgatcccaaatttccccttttgtacctcttctttccaaaatccttcctccacaaggttcttatcgtgcttcccgcaacctgagaggacgctgataggagcctatcgacgcggttgggagccccgaaaaaagattggcagagtttatcagctcggaaacagttgggatttgccaactttgatctgatatttcacctggattcatttccgagaaatttacacctccaaagaattttttgtaagagttttcaggcacatcagacagatgaaaatgaagtcaggtggaggtatatatggcgattggtgacgtcattggaagtacaaacaccttcccagtaaaatctccactcacccctcaccgcccagcactgatcttcccaccatcgtgacgacatatccaactcgctgattaggcataacagaaggacggaagaataaaactcagtcatattggtgtccacgtgaccatcagcgtcgccgtcctcccctctctccatccaaccctcttgtaacctcataccattcgccatgggctattcgaccccaaaccacatcccgccctggatcctctgattagtaagcgaattagttcaaaggtcacctaaacaagtgcttcacgtgactcgcacgcctctgtttactcactacacgaactgtaggcgagtattttttgagcgcaaacagaaaaattcgctatattacataatcgtcattacataatcgttcacacctggctgttcccccgctgttcccccgctgttccccgctgttcctcacatgtaaggtaatgtaacagctccagatggtgcatattacacaaaccgactttgcattactttttttagacccgctaagaacaatgtatgtatcgtaccccacaatatggagaaaaaaagaaaaaaaagtttgggttggaataaaatttcgagcaactttgagttccaatctggaaccggttcgatagccgagggaaggctgagaaatacgcagatttagaagaaggactttggaagcaaccaattgagcagtttagtcgcagtagtcgcttttggacgagttggccgaatctaaatcacgtctctgaggcggctaatatggacccttctgtagtctcgcgtgtatatgaaactctactaccccaacatatatggagtgggcgggagatgaaagaggtttttcagagcaataccgagccgcagaatgccgtttctttgtcgggttgctttgtctgagtgtttccccgtgtttatccgtggttttgttgtgctagtgtggttacgaggaatggccgttgttcaggtcggccaatgtccggcagtgacaataatttcaacatatcaaaaagagaagaccagatatcctcaatgctatctatacgagggtagtttcagctagtttctagcacgaaaaactaagcaaactacatgattcccactccatccagggtctcggaaccttagacaaacatagcccaacccaccatgatctcctattattaccgtgttagaaggagacaaagcgtgtcatcttgtaataaaaaaacacagaaaccgtgtctaacaccagtctgttgaaattccggagcaaatcagactccatcacgtccaaaaaggcccttcttgtatctctccaacaaagcctaacatactgttgggaaatgtggggtagcagggctggttatggcgtcatattgttagcgtgagggtacgacccgatcggattggatccggatacctacgactattggagtggtagatagttggacagcacgttgattgaagcgttattttacacctgttgacggtctagatggtgatgtggtaaaagttggcctcagtccagcagtaaagggtacagtactaccaacgtgtacatctcaaggattgcatcctcagcaaatttcaactacagtagtacatctttacgccacattggacatctccatgtaccccagattctagactgcacattctagactgcttagtgagatgcacttgaaccaagcctagacttgcacgcacagcaaagatacatgagtactttgttagaggtgcactgccgggaggagagtttcatttgagagcacatttggtgcaagaggtgctgtacaagcggtacatgtccactatgtacagtacatacttgtagttcgatcgttagagctatcgtgaagagaggtaaacttgtattacagtatagtgtggagaagagttggagacacataaatcatatcaagatgttcctcttgctgagacaaacacgctggtactattattttcataatacctcaattatagcgtcgttttgagggacttcatacacctgccctccagcatcgtatactctacatactgtacttagccgtaactagttgtgcaacaatatcagccatctacagcacaaaaaagccggtaatgattcgtcagtgtatacatgcacgttcccacagtctacagtctacagtctacagtctacagtcgccgccattccattgcaaatcattattataaattactaataccaaatacctattgcttcttagtcttctcagccatgtactcaaagaaggcaaactggccagggttggcacccttctcgtagacaaatcggccagcaaggtaagagccaaagatagccttgaggtaagactcgggaacacgcttgagcataacatcgagaccaatctcgttgaccagcagcttggggagagcctcgtgcagaacagagtttcggaactccacgtcgtcccacagagcggagttcttgagctcaccagacagatcgttgatggcgatagacagctcgtcggagagaatagatcgaggcttgccggtcttctcgtgctctctccagatagcctcaaactccagtcgggcgttgttctgaatgatggactgcacctccttgacgtaggccttgtagaactcaggcacaactccgtctcgaatacacatgtccttggcgaaagactcgtcgtcaaaggcaagagaggcaagaacctccagagaagaggaggtcacaccgcccttgttggcagaagcgtccttgtagacaacgacaccggcctcctcaagtcggagcttggcctgctgggtgatgaacaggttggcaccctcaacgagccacttgatcttgggcttgccatcaacaaacagctggctgacgttgttgatgtcaatggcctcaggtcgaccaccgcagggaacaaacatgtcaacagactcgcatcgcagatggtaggtgtttcggaactgggtaccgttggaaacaacctcaccagatggcagagtcacgtcgttctcgtcaacaagaactcggtaaccctcgggagagagcttggacgcgtcgtactcggagatcatgactcgtcgcttagccagggacaggagctcctctcggtcaagtccgttggggtcgtagaggacaccagcaccgtcaatgactgtggtgtacttctcggcggagagaagaatctcgttggagccgagatctccgtcggggccaccagtctgctgccttcgcacggtgggctgctcaatctcgagctttcggtagatacccttgacgtactctcgcacggacagagaggtcattccgtactcgtcgtgagggataccaccgagagaaggagacttgccagtgaagaaagacttccaccagggagcgcctcgctgcttggcgtgcatggtggcccagttgacaaggccagcggtgttctcatcgggacccatgaacagaatctcgggagagccatgcaggtcaacgatgggctccttgatgccgggagtgtcgcccttgaggagcaaatcaatgaccgagtcaatgtacttgtggaaggcaatctcggccttgtcctggtgctcgttgttgagcagaatgacacccttggagccaccctcggggatgtccttgttctttcgctgctgggtgttggcgaggttgtagttctcgtcgaacatggatcgggcgttgattgagtaggcctctcggtttcgagacttgacgattcggataccgccacgggcaatatcggcaaatcggaggtggaaacctcggaactcctgaccaactacaaggaacataccgtacaaaggttgagggtactcggactcggggaggaagtcgggagagagtcggaacgacagagcaaccttggtaggggtgtagaagttggtcttgagcacgtgggtgttgaaggtcaggaaggcctccattaccatggcctcgtggtcgttggcggccttctttcggatcagcttcttgagctcatcggtggaaagaacggactgggtctgcagtcgctggtaagacagggtaggcaggaacgagtcaccctcggacttagactggatgtagtgcacgtcggcaaactgcaggtacatctgcttgacaacgtcgagctggttgttgatcagctcaaacaggtagtctcgggtgaaggtctcctgtcgcagtcgtcgcttgagcttctcgagaatctcaacgtgctccttgccagtgccgagcatctgctgcagagtggtgtactcggagcccagacggttgaggaagtgctgcacgaagatgaaggcgcagtgggcatagatggactcctgcagcgacatgtcgcctcgggcaaagtggtgcttgaaggcgttgttgggcaggcagaagagcagagaggcctccttgacaatctggtggatggagttctcaatgggagggtaccgcttcatggccttgatctcatcagcagtgttggcggtctgggggaaggcgggaaccaggtacatggagatgatggtaacaccgttggagaactgctcgacgtactttcgggtggaggtgagtccgtagaagtggtacagatcggacagagcggagaagtagccgggagtagtctcctgcttgtatccgataatgacccgtcgctctcgagagccgtcaatctcaaacatctcgatgacggggccctctcgctggacaacctggttgacaatctcagagtagatggctcgggtgtactcggtggccttttcgtagaaagttttgtcggagatcttggtcagatcagtctcgccctccttggggttgggctcgatgaagtcgcacttgtagacaaagtagcatcgcagagcgccgtcaccaggaatggagtcgttggtggctcggaaggtctcgactcggaacttgccgttggggctagacaggtacttttcgtcgattcgggtctcgtactgggggccctcgaggttggtggtgccagggttagaggtgtcgatgtagaaagcgtgggcatcgtcctcccgcaccagctggatgtcaagcttcttgtcagttcgagcgtaagcagcaatcttggcagaatagagggtgtggatgtaggagacaatgttgtcgatggactcggtagcgaagaaggagtcgtcgatcgagagctgctcgtagaaccacttggtttcgttctcaatcaagttctcggggatgaagcccttgacgtcaatggcgtccatgactgggttagttgcatgttaagtggacagtgtcaaaaagggtgacgacaatagctatgtagtgcgtgggccgaccttagcggcggtttgatctgacttcaatttggtgatctgatatcatcaggcatcgttgagttgatccgttgagtcaaattgtgctgcatgtggttttttctcttcatgccaagcagttggtagagatggcaaatgtacactctgtggggtgggtgcttaaagacgagaatcgcgcaataattggcaaactagttcacgttacaccactcgccttaactgtggtttcactccatcacaccacctgatgcatgcacccgcctgagctgcagtgtcgattgccgtacgacattggcacagtaatgcagaacaagacagacacaaacagaccataacacggtgtttttgctcacgaccatgtataattagggtcacagagttggaaaatgctcatgaatgagtggagagacgccacttttacgccacaattcgatccaaacgcaaaccgatccgctcagatcaaccacaagcaccgaaaccggttgtgaatcgattggtcaccaaataaacccagagacgttgctgtctccgatactaatactcacccttctccatctgggagtccttgccatcgaacagaggcgagttgtagccggtctggttcttgagaacattgttcttgaccaccttgaggccgttgttgtgggccagatgggctgctgcggcgttgagggtgtttgtgttggtggcagcctggggctggtcacctacgggagtggcaggcatggttgtgtgaggtgttggttttgtgtctctcaattgtggaggctccagaggtatatatatatataggcatggtgcgttcccaaccggccctcctgtgtgtgtttggtttgactttgtgtttctgcctaaccccaaaaaaaaaaaaaaaaaaaacacaaaaagccagtttttgtgcgtgcatgcagcctccagcagaagcgtcttggtggcacacttccgagctgaaccttgttccccgaggagcccttgccaaagtgcaccgacatgtaagaagccgtcgggtcttgcaaaatagacatgcactaaatggatggcggtgatttgggcctacaccatcgtggcgtgcgtgggagagagtgtttggcccccaaacaaagagggtcggagatgatgctatttttgggtgagtactaatgacagcttgttgattgttgagtgtcatgaccaatggtggttctgactctgtcccgtgcaccgttttggcaacgcacaagcagcctggggtcacaagacttgacgatacatgctggcaactgatgacagggtcttccagcaggtacagtacaactgaagtacgcacctgactactggcactctcccaagaaggtaaccttcctccccttcctccccagacacacgctaacattacatttcatacatatggtggtctcggtaccccacacacttagctctcatcgctaacggccaaacccaaggcaaaagctgccgcagtcaatagccgcgtgagaaagagacaatcgacgtggtgacagtgcgataatggttggtgctacctaatacggataagtgtcctgtttgaatgttctaactaactataggtcgatattacagtgctaacatgctgccagactacgagtgagtgtgctgtaaaacactactcggcggcccctctcttcgagcgcgcgctacgacacttgaggttcctgtcggtcgctctctagacttgctttttatctcacatcgcacccaacctcctaaacggaccctttttctccttctccagctggacgaacgtgcggcgcgtcccaaaagggcaagccaaccttgagtgtggattctgggggactccatggcagagccgttcaacatactctacattacggggtgcgtaatatgtaagagtttgggtctggcgggagcatgtcatatgtggcgcttgtgggacttgggacgtttctgcttctgacgttttcgacggtacagtaagcacaagtatgacgtctcctaccggactggaccatcggagtatggcactttgaactgtgagcaatgagcaatgagccatcaccacgaacaacggaacttgccgctagccgccagaatacccaccagtacacccacatacagccattccgacgatactccttgttccatgtcttttccccggtgctactcgtaccgtaaccccaacatcaccaccccacatgtccggccgggtaacctggggaaattagctttggaaaacgctaaacgatcctccccccgagtttctccttgaggcagttatctgcgaacgttctgcgagcgttctgcgactcatgctgcgaccggaactattgatccgagacactcaagaaggggtggttggggcgcttttttcccgcttttttcagcgccccgctggtccaccttgcaactgggactccggccaccgctcgaaatacctcctctccacaacaaaggttttacgccactcggtggtgcaccgcctcgcacatttggtgcactcatttcatttcgagtttggtggcaaacatgttggtgcacgattttggggccgagagacggcggttaaaaacggaggttttggggcacacttttagcccacgaggggaagttgcggcggaagaagaagaaaaaacagaagtggatgcccgcatactccaaattagtggggtccgttgcatcccaaactcacctcccacacctggtgatattctcccaaaaacatgccgcccaaaacaccgctcccaaaacaccacggtgcatggaaaagaaagtctcttgcccgggtttcctctgtttttcgtgccaagcaaaaaacaacgcccaaaggatggaccggcttatctgtggccaatggcgtcgcccagataccacgaaaaagagcgtggaaacgtgatttctaagcactcgaaacgctttacctcggctatcaacaagggaaaagacgattaagcatcgccgaatcagggcccgggcgttgaacgtgtagggagtacattatcgtgtgactcagacaatgtgaaaagaccaccgttacgattccgaccacctacaagaccgatatcggagtcacggaggacggggacggggacagggagcggcaaggtcacgccataactacaagtacaagtacagtacggtacaagtaatttagatggaccgtctggttggacgcgtgactcaaacgtgtctttggacacactcgttcctgtgacgctccactatctcttcattattatgtgtcgtctaatccatcgtcatatatgggttttttttttccccaaaaattccagcgtgaaatttcaaattaagattttccgacatcggcgagaatcgaaggtgcggcggacgtgcggctcaagaaaatgacgtcatttgagaacgaaccagactgctgatttgaccagtgaaaagtgcaatcgacggagaatcgaccagagaatagtcgtatcaagtttgtatttctctcacgtgatcagccgtcctgttacagcgtcctgttacagccataataagttccgcgttatcctctctaccccactctcctcgtaccttaactcagtgtgagaacacaatggttcttcggaatgctcggaaagacgacattcacatgtgcggccgagtggagagagtgctggagccggatatatacttctatggagtgtttcggatgtgttacaggtgcaccagggggaggactgtggagatagtcacgtgagctggtggagctctcccagttctctccgctcgtgcttaatggcggttctggtcatgactcatggggactatgattcatgtttgataggcacaactgtttgaggcggttgcgttaacggtgtatgactgcagacaggcagaagagagaggatagctgcgtatatgagctcctgctgagtaacggtgatgattgaggtctttagtagtcgataatgagttacttgtacaagtcacatgaagtgtccttgtgcttgcttactaagacacataatgtattcagaatgtcacagaaaacgaatggatttcacgaaaagaaacggcagatattacaatcacgagaactgcatttaaattactaaaatccagctccaactttctctctggagttgctctgaaggtcttgcacgagccgagatctatcctcaatgtatgggtaaaggtctcagatgtgtttcaactgcttcaaagtggagattaaacggcttccaacggcttctaacggctcaatcaggctggtaatcaactgctattcacgatagttccttcatatagtactcacaatggttcccaaaggttccagaagtagcaaagagacaagaagtcgggaagtttttcagatggggaaataaaaaattgcttagctgataaattgaacgtgcgtattgtttccatatgaggtttgtcttctctactttacggaatttcgttttacggatacttttgttccactccctccaaaaagtcattatttggagagtattcagaattgcaaatattgggaatattgatctgtaactggaaaattagaatgatatagtagcatataactattttgtcaacttttcatagctctgccattcttgtggagctcgctatttcacttcatatgtctccccattatcgtcgcgtgtgaagtgtattgggggactcaatgaggagcattttgtgtcgaaaatgcatctgaaagtagatggcaagagtaatattaaggataactgttatttatgtgacttgtgaaccaaattgagactaacaggagtgatgatattttgggggagacactcaagtaatatcccagtatgatgaatatggtattcaactaagttcatactattacactaaaaatgtcaactaacacttgaaggctacacatgtttaataattggtcaactatgacgatcagttcaggatggaaaagaagttggaaagagaacaacggaggacagcgaaggaaacattgccgtagactagaatcaagagggttgaagctataccattgatacaaagtacctgtgcctcaattaaagcgcgacagccggggagtttgtagttgaaggtcagaaccactcagatatagaccatcttcccgctgccgtatgttgtgaagccacttgctcactgtctagttattcactgccagaagacaagtcactccagaactggatctgcaacctgagctcttacaatgggtttgtcgaaactgtgagggctgggctgaagccgaggatgcacttcaggtagctgcccagacgtcgacatgatagtactgtactacatgtaatcaatatagtacggagagaactattccaggagaaccgtacgagtatagagcatctgacattgtgactcggtgatgtacaagtacagtactcattagtacaataggccttactcgcgattgtgctcgatgggccctcaacggctagctttccagctccgagccagggctgctactaccctcttgaactaatgggatctttggagattttgaacataaactaaacaagttggacatgagacttactactaacacatctggtttaaaatcaggaccttgttgtcgtttttccaacattgtaaagtactactagatgatatgtattgaagccatggtctttagatgagccaccagccgtcaatgaacttgtcttcttcagactgacctcttgtgtttttaccgagtctggtcggagtataactacagttgttggaggttgtgttttgcaaggagacaagaattatatttatcattagaatcagtgccaaatgatgaatccattgatgaactgtttgaatccattattgtcaaagacactagattggggtgtttttgtttttttttaaaaaatcacatttatacatcaactagatagatattgaagtcctatcggaatgtccctgttggagcgcgttgatgatgtcgccaagtctctcacctgattatcggagaaagtgggtggaactacaactacagtatttattggaacatgaagtacgtagttatgacatctggctaattttcctatcactgacggagtcgagactccactctacccacagagtcaacttgtcttatgtaaagacgtggagttgtacctgaaagtgccattctcatgttttcaatgttccaaacacccgaaacataacggacttcccaaggtgcaatcaacgttctcgtctgccatcagggaacctccatgtcctcatcaacgcagcccaatatgactacgagttttctggcaacttcgtatttactttggtgtgtccgctcttggttcgttgtgagcctccgtggaggcgtggaacaggtattttccgttcagctatgttcaatctccatgttggaaaggatgagcaatggacttatgtttgcgtaaatcgagtccgcaggtcgcagtccggtggccttctcaaaggacacccgagacgcaaatccaggcacactctttgttaaacagcgtactagtgactacagcccgggcaagtatctgtttgaatacaggcaggggttcaccactgtgcttttcaagagtgctgtgcgtttcaagagtgctgtgagtataaagacctacagctaagatagattgcagaatagtaataccagcgttggtctcttttggagacagttcaacaagatatatcttttacaaccctttccccaattgaagtgtctgggtctcggtgtaggtgcagttcaagatgataatagcacctttaatcgctgttagatgcccattgttatgcttgtagctggattatcgcagacctgtcttctcatgtttgtactgtcgtctcatgtttgtactgtcgtctcatgtttgtactgtcagccatattggccttcaattaacacctacagtaccattcaagacgtatactaaagtacgtgcaaaggtggttcacgttcagtagcccaatgactcgtcatagctagatgcccagtcaacagtctctagttgagtttttgatactgctccatccatgctcgaactggctatgatctgcgtcattgacttctacggaaggacgtcggcgagctgttcagtcgaacactcaacagtgttggtttactctctggactcgatgtgacagtccgctcatcggaaggacttccagccttgttaaaaaaccggtcggttagacgaggagctgacagactcttcccgagttcggccataagttcaagtcagtaacgggcagtccaccagtcgactgctctcacacgttggcttagagactctcttcaaaaagagaagacagttggggacaaactcgagagctttggagattcaagtctttcaccttagtctgctcaatcgtctgacatctggccatctgacggggagcttgtgattccagcagtctgttagtttctagcaagggtcaacttgaacagacggaccagccattccattaccggcaaaatcacttgcagagtttcgttaaccgcctctgtcaatagatctcgggttaacaccatcattaacagccctgcaacaagtcatggcatggatcattgcattgatctcacctttggatctggtgttcaaaacacggccctcgtagtgatcacctacaagacatttctcgccccaaaacacaactggaactcagcaaacccatatcgacctcagttctgctgctcgggctcttcaaatgatcccaaaccgagagcctacctcccagagtttctgtcacaaggtcacgaggtcacgagtcacgaggtcacaaggtcacaaggtcacgaggatggtcacgtgatggctcactcactcacgctctcttcgtccaatccacttatctcatgtgatgagatttatcatcattcccttcatccagtcctttttgccgagattttccgagtcagtcttctttgtaaaggagtatctcgaggagggaagtcctgtttctttttcctgagtaatttctctcttctttgcggtccaatttccaacataatgacgtgcgttaggcagccagagatgctgtgttatgagtagctctcatgtaatgtgacatggattatggcgagggtccgagtgaatgagttgtggtatagtaggtggatagcccaactctaccaggtcatctagtaaggagtctgactaccgtctcatcagatctgtggaacgtgagacgggtgctgattgttccaagccattgccatactgcgatgagtcgaacaacggacttggggaataaaaagcaacgagttttgacaggaaggcgttggagaagcggttgattgctttttctgatagccgaagcagggtatgaaacctgaaaacagggtataaagggcaactattcaatgaccaggagtggttggggtggagagcaggagtgagcgatagtagtcggtggtgaagtctgcggtcactactcggcagtcctacttgagcgtcaaccggcagtgagactacttggtgcgccggagccttcaccaaaggcaaagctcaaccgttgctccatccagtctcagaagagaacgaaacggtttctgaggttcccgtatgtgggttggttcttttctgagctccttcaacatgaacgactcaatgttcctgctgaggttcgtcggtacagccatccctggtctcttagagatgagagtctgctctccgaggcgggtggttctgtcattggaactgtgagactactgatgttcatggacatgtttgtcttggacatctcgacactgaatcttgatgctgatgtccgaggcaagcgcttgcagtacgtctttgccattttccaggacggtgaggtgtacatcttgaacataatcctagatagtacaagatcaatcactgtgctccacccagtcagcgagctcagtcatggagcccagtcagtgcccattcagtcagattctagattccaactccccgtgctgctcacgtcaacaagtgacattgacatgacttgactgacatgctcacattactttttccatctgagagtacagtacaagtactttttcctggctgcccctgcccctgtaggccagcacgtttttcgctgcagcgctgtcgagaccctgttatggctgctcttgctgtagcagccaccgttgatatcaacagcagtttttagatagatggcgtaacgtaacggtatggattatagaaaatatcgacagaaagccatttcaaaaaataaaataaaataaaataaaacaattaagtccaaaaaatccaacaaataccaaaagatttagagggttccagaaaactccaactcaaccactccaataaatttcaaccccgatttttccgctattctgcacaatccccaaagtccgaaaatcccaaaatcccaaaatcccaaaaatcccaaaatcccaaaatcccgaaaatgcccaaaaaagacccaaaaagacccaaaatcctaacctccaatcccactctctagcatccatcattccaagacaattgcttttatctccgccacgccacgcgacgcgtctcttctttccttctttcatcagccgacccatttccgttttcctttttccgctttcctttttccgttttccgtttccgtattgcttcgttgcggtcttttcgatgcgctgcagcaacactaacgggaccactgcatcaccagcctgtcatgccgaataaaacgagacccaaaatcctatccagacgccgcaaaaaaacaagtaaaaactgcatttcgctgcgaaaatcaaccgctatcacctcgtatatccggaacctccccattatgcttagtcagccaccaatgcctctcccttctccctgcacagcatcagcatgcacatatgcacatgtaccatatacgcagccaagacgcacctgtagcctacatgcatgtggtgctgcagaccaacccgtacagaagagcatgagcgcgcgaaagagtacacgattagtcagtgtgtgatgttgtacaatgactgagcatgttgtagtaatttggatcttgaaaatggcctctgctgtaatccattgcattgaaacagatgtggtgaatccaaccccggcctccgtttttcatttgcaatttccctgaattgttaggtgtttatcccgcgagttataatgattcatacccgacatgtacgggtactcacacccttctatccaccttgtccgaaaattccctgacgacatcaccgtgtaatacttgaatcgagctctcatgctccagcatcgcagatgtcacaacactttggacactggattggccgtatacagcatttctccgatacgacatgacgcgcgcgcgaatggagctagagctagcaccagaagcaacccagaagccactagtcccgatctcgcacattagcgacagttgtctgttgtgtaaacgcgccccaggtttcgccggtatttctggagttgcatttgcttcggtttttgggctggagctagccagcccaaagtaactggaaccgtggagatatgcaccgatggcgcttttatgcatcccaatgtagtaacgacatgaccaatgtggtaacgaccgggaccaatgtggtgacaacatggtcagggttgcgggacaacatggtaagggttgcgggacaacatggtcagggttgggacaacatggtcaatgttgtgcaactacgcgaccaatgttgtgggcatgtctttgggtcaaggtggatgattaaagttgcagcatgactaccctcaggtggtgttcaactgagagtgttagtcaagtagtatgtacagtatgtatatataccggaatttgtactcgccagaatctgaatgataaataatgagaccagtgatttattttgcattccaatttccacacggttttttttttctaattttttctaattttttctaattttttctaattttttctaatttttaatctttttaataaccttcagatagccgctttaaccgccgtcgaatgatcgccgtaatgcacctaatgtctaatgatcagagcaacgcacagagcgattcaaatacgtaccggatagggaggttacggccagcctcatcacatcacaccagaaatgtataccatgacataagccatgtaatgccaacacaccagacatgtagtgccatcacagcagacatgtaatgccatcacagacatggagtgccatcacagacatgtaatgccaccactctgaccatggtctaaccgtgcggacgcttgccaccatcgccaacggtcacatgacccggcccaccttctagaagatcttcggtgcagatcgctacaggacaatcccgaggtccacgccggccggctttatatgcgttaatatcgttcttgtagcgggaattagcccgttgagatcttctgcgcggctggagagggcgtcgcacgtgttcgggagcggatccggctaggtttctgttgatttcctgacattgtgtgatcatttatgtaattttcgggattattttgattattttgattattttgatttttttgatttaatggaatcaaggataatccaaataattcgataaatccaaagaaatccaaagaaatccaaaagagggaaaaaaaccaacaaaaacatcaacaaccaaccccaaatcaaaatacacgtcaccgtcttccatcaatcaatctctcttttcactcaaatatgctccgatcagcatctctatcaagacaacttcacagccacaatgagcaaatatcgcttctgaatgtgaaaccaaacgtcctgaagaaagagccaattcgagagcgatctaagaaaggtagaaaacagctgaggcccggaaatatatctgcaatcggcccaaaatcaaccaaaaccaccccaaaccccccataacctgttttctaccaccccaaaccgccaaaaaacccccgtgacacccctgacaccctccaacctgctctccaaccacccacaaccctcctcccctacccggccatgtctcacgatcaccgttgaagatcgttgtggctcccaagcccaaactgaagatggacggaacaaagccaaactgaagatggacggaacaaagcccaccaaactcgtcgacgatccagcacgtgccaatgcaatgcaatcacgtgaccagacaatatagccgccgcctgcaatctcgaaatcaactccagatcaaaaattaaacaagaaatctgccccagtcgaaaatcgaaccgcggaccaaatatttgcttactcagcaaaccttaagaagcccttaccctgacatgatgcaaaatggcatgtaaaattgtgtctccagacgcaccgtgaaaaaacccaccgacacttatcatctcatcatgaagggaggaatcagaattcgactggcgcgatttggccgacgacactcgcccctgtacaacattgtggtggccaaggccggccagcgacgagacggtttgcccatcgaggtgattggcacatacaaccccattcctgccccccggtcgcacgaggagctcaagagaggcgtgctgccggtgaaggacgtcgagttggactttgatcgagcaaagtactggattggaaccggtgcccagccgtcggacactgccacccggatcctgatgctggctggcgtgctccctgaggactggaagggagtcgacaagaagcagtaggtggtctggggggtgtccgagagtgagaagtattgatttgtgttgttgcattgtggtggaagcaaacggtgcagacacagacacaaaagggctcagatcagacacaacacaatcacacaatcacacggacaaaaagagacagaccaaaagagacagacacaaacgcgaacggagtgtgactgtgagggatggttgatccgacgagaagcagagtcggaccaatcaggaatcttgtacatagataatggatgtttagttgagttgaggtggctgaagacgaatagtgtgatggaggtgcgtgaaagggttaagcggtggtgtcgagtggatctggagcgggctagagcggatctggagcggatctggagcggatgtgggacaccggtggaatgagagagaggaggggagtcagaagaaggtctgacgaatatcgagggtaggttcaaacagggggagttgggaagcgaggtaaaacggtcagttgcgatcgcattacattgaaagtagtatcaaattaatcagagacacgaggagagtccaatgatcattgttaatctcttgtaggagcagtatcgaaagcgctggggtgtgttgtggtggtgggtgtcgtgtgtgcatcacgcagactctttaacgagattggcgagtcggtggatcagggggtgtttaaattttttttttgtaaaaattgcaccattgtgatcatcgtgattaggggaacacaatggtgtgatttccttgggcatttgttccatgtgtggaattttggcgggatctgaattgccttggaggacaggttggagttcttgggcggtcggagatgatcctgatgagatggaccatgggcatctggtcaacagcagtgttgatctggaacgagatgatgattggcaggcccaccaactaccccacttgttacaggaccaagacccatggagctgtaaaagaagtatgatggcaccgatcgtgtgcaacttgatggtgaagaggcagctgtggaagagggcgtggaagaagtgacgatggatgtgggggtcgcggtctcgtcaaggtaggtcaccgtaggatgctgagatggaggaggccaaggcgtctgtgagcgagtcgcggatggacggaagcggcgacagcagcgtcggagaggtgacggagggagctctagcagggccggtattagcagcagcgtcggcagcagaagtagccgaagccacagaagacagggcagcagtctgctcgtcacaaggaggagacacgtagttatcgggacagatattggagtacttggtgaccatgtggagggctcggcaggggcgggagctggcgggagccgaagtgacaggagcaggagaaggagcagaaacagattcggaagttcttgactgtgctgttcctactgaactatgctaggagaccagcactcccgctgccgtccctgcccctccccgccggccagaacatgtgagacgcttccaaccccagttctcggtgatgtcaagtctagaaccgggctctggttgtcgtgtaagagaacccgagtgcgatgggatcattcttgagtgacactgggtcgtttccaaagctggcagattcatcggtccaaccaggttctcacagtactacagatgacgcctactagactgctataggaccagaccatggcactgaagttggctaggagattgggatttagttctcaaatcacaatctcgagaacgcacgttcacgagaatacccagtctgtggtcagcgactcttcctgactactacacagcatcaaaagctccaagcacttgtcatgttgcacaagtcggtcacaagtcggacagtcgggcagaggacacaggtcaatcagtggggcaaaggacgcaagtcactcagacaaccactcgccgtcatctacatctacatctacatctacatctgcagtactcgtcaatcgtccaattccagattgttagattataatatatatccgcctgcggtgatgcatctcgtgagagtgattgtggtgtgttatgttaggtaaggggttccgtgtgttcgatggaacagataaaacgggttgcttgattcgaaccgacaatgtttgatgaaatccggttcgaaatccggttcgaaatccggttcgaaatccgcttctgcggcggcgaaacccgagttcgaacgtgcgctgcgactcgaactgagctgagtgcgtttgaaatcgaatggatggatctgcactcgctgcactcagattgacacactcgaagtgaactttggaacctcgttgcgctcagtttgagcgtgctcagttctttggttacttcttctgctgccctcgcttaaacctcaaactatctcgctttcgctgactagtaatattagtcggaagaccctccacatcctcctccttggggtccttgtcatgcccatcgcccatcatgggactttcggcgagccgcttgctgccgctaaagttgaagccctcctgaaacgggctctgaagaggcaccgaatccatggaaaacaccggcgactgatgactcagcgtgattcgagtgggccgcgaaagagtgggcggagtcagaggagtgttcgagtcgatcgaggtgtccatggcatcgtcatcctgaagccagtccgagttgaaatcaacatgtccagaactgctgccatcaacgttctcgttcacgtgatcacccgagctcacgtgactgccaaataacagcgtgccagcaccctcgaaattgctgttggactccttgacgggcgtctgacccagtccaacggtatttccaccgccacgctgggtcagcaccagcagtcgccgccggatcgccaccatcgagtgggggaagtcacgggactcggctttggcgcgcttggcgcagtctttggcgactctgtggatgattcccgagggcggggtgtgtcccacgaatggcgcaatggtcgggttgtccaccaccttgtagtaaatgtgcatgaggaacgcgtcgtcgtgttcgggccaaaactggttagaaatcgacgtcagcgggttcgagttgagatcactcatgtatccgtcctcgtcttccgacgtggctactgacgacgtgatactgttgtttctagacagatatccatggggagtgtggatggtctggtccatgggggtcgacggaagcgaagattgcgacgtgttggacagagtgcggcccagagcggctcccccgcacgattgcgggttgggcgagttgtgcaaattgatatggagattgggacgagtcgttttcatggcggacgaagagggggaggaggaggaggagatgtccacggaattagatggagtcgaaattgttgaagaaaaatccacacgaggaattcaaagtaccaaaatgatgccggaaacaagacaaatccagcggtcaagacgtctttccaatcacgtgagtattcgtagagatagtgtcactaatctgagtcactaatctgaacgcgtagtgcaatgtagtgcgatgtagtagtaatgtagttttagcggcgaaaagcgtctgaaacacgagtcaggtggtttcctggagtactctggtagttgttctgttctttttgtgtcgcttttgagtcggtttgtgtctttctcggtcggttaaaatgtcccggaaaaaagtcgcgtaatgtcctactgctggtgaggtcgtaatagtggtcgaatagtggtctgggggcgtcctttaggtcgaaaataccctggtcagcgtggtcaatgaatcggggctaaaaacaggcacgttcgtaaatcgactgatcgttcacaaaaacgatttccgacgactccgacagatgttatatgggaaaagacagacaccagatatcaatggtggagcaaagctgcacccagagcttactcgtaaacccaatagggttatggtttctacaaaaacacaaaaccgacccgcaacacaaagaaaaggctatttttaaaccactcagcgcgatttccatttgactacctatttgggaaagtgttgctgaacatagagagaacattaaactttcaaccctaaccctaatcacgtccgatggctggctagcaagggatgaaccttgaccaggcgcgtctaaataatatttatgaagaaattgtggacataattcgcaaggagttatgcgggagtagcggagttggcgatttggcggaattattgcacaatgaattttcaaacgctggtagttttttttttttttggggggggagcgattttcgaattgtttggtattctttttaatttatttaggtccattttccctgaataaatccgaataactttagacagtcttgtgaccaagttgaaattcaaatttgacccgacaaaattgaatcacgtgatagggatattagcgagcggttttatcccctttcgtatctatttgctttgtactgtgatttttcctacatttttcctacatctttcctacatctttcctacatctttcctacattttattttattctatttattttaaatacgtagaaaacccctagtgccgatcctcaaaaaagggcgtgttaagaatgcgggatgcatgaaaccagctgtatcgacgccttgcgggcggaaatattattttagcacacgtgacgttgcattggaagtggttttggaggtgggtttttggaggtggtttcttggaggtgatttttgtgatattatttttgtggcatttattttgcctttttcccagtcgatttccagccatttttgagaatacgcgtttttttttttaattttaaataatccaaaaattaccccttccttcgatgcttacataatcggggcagtgaatcggggcagtggcatgactaatcctaacaaacctcatattatgggtacgtaaagtgtcggaaattcatactatagggaacttcacgtgacccattccatcgggacgtctttttcagctcgattccgtcacgtttacgtcgttctcgaggtgttaccctactatatgtttgattactaagcattccaaatgagtgaatgcgggggatttttgcaggattttcttgtcacgtgtatttgcaggtggtctatattcgtaagtcggtttttgttacaaggtatttttatttattttattatttatatttacttactttaattattaaatcaattaatttaatatttcttacatcggaaaatcactgctaaacctcagatcgtgcttcactccgttttcgtccattctccgcccattctccgcccaaattagacccaatatgcaccccgacacgcctcaccgaaaccccgcaacactctctcatttttgttctattttcgcattttttttcccatgtttcatattaggctttgggctggttctgaggggacgaatttctgaaatattcacggaaaatcgcagccaagttatagagccataatttgacggccaagtcgatttttggagagcttcgcgcagcttgccagttttttcggtttttttttggagccacaatcgcgttttggaaggtagtgcagaatgacgtcaatatgtaaggggaaaaagaggaatgatgggcagttggagggacagatgttggcggttgtaatggcttttttggggttaaattgcacgaggttgggtgtcgaggacgcgcctaatttttttaggagcagtttagagagtattttggagctgtatggattttttgcggaatttctggaatatttttaatattgtttaataattatggaaaatacaggaaaaataaaagtgcaaagtaatgcagccgaaatgacaccttctgaagtgacaagaaaccaaggaagtcaattgaccgttaaagaaggccctaagagtctactgacagctcgacatacgtctcagagctccatgtcacgtgccgggccggtgttgcatgaggcggcaggtccggaagaagagatggtcatattgtggacaaaggagttgggctggaagatcaagattccgtatagacgttgtttgtgttcagggtgtcatctgcaaaaattttggacttgttagaaccgaatttggtcgagttgaagaggggcaaggaggagtcggtggggaaatctggtttacttggttctagtggggaatttgtggggtaattgttaatctttacttaaacgctatgtattgaagcaggatcatgttagggacctcaactaaatgtaagtaaaggtgagtgaagcgaacgtgtctctagaaggacgaatatacattgtgaagaacaggaaaaggagcaaatcatctcctccaccccctatgaccataataatcccctcaaccgccccagatctaagtctctactagcagataataactcattctgttctagacagggcgtttgcacggagacactatcaaccagaccgatctagaaccgtagacccaggacgggggcggaagtcaaagaataatggtcacgtgaatatatgatatcatcttccagtatatacacaaggggtaagataatttggagttgagattcgaatcaaaaggtcattgagatttcagtatcttaatcatccaccattatgctcaactaattagttgtctttagttgggataatctagattactaaaaaatccaagtacgttacttgaatatcccaaggatcttctactactacaaaacagataacatacctccaccagtacacaacataacataccacccatctgatcaacatttctatcgacccaattcacccccaaatcatccctaattcaataaaaaactcttgttcgttccaaaattaccacaaaacattcccgccctttcgaaaactcgttgcacaacccaatatccaattccatcatatccgtctcatctttctccacaaatcgacaccaaacacgtccatgtatccgtttcacatgggctttagccggttgcagaagctcccgagacaccacatgtcatcaactctatgacagagtctaactttttccaggatgtcgattctcgccgaaaatgtatgccagggtggaaaataaagccgccagtccgaaaagccgtggcgaattgtccctgttttctaccttctcacctccacaccaccgattctccagcccctatgtcgccataattacccccacctgcattagcgcggctccggaaccggaatgggcgctaaacccactttgattggatctctggagcatcaaatgataccaagacgcgcgaaatttgatcagcaatgcactgggctggtcagatccaagatccgatcgaaattggagatactatcaccgatttgagatttctcccccaaataccccccaaatcccacattaacctattcccaccctctcaatcctacattctagatgtatcacgtgatgccatattctccaagtatctctgcagattcccagaaggtctcaattgggtcaaaagcaacggcagatctcggaaatgaatctcagggatgaggtttggccagttgcttccacgtgccgccgttgaagctgcgaaaaagccgcctaaaagcccattgagcaccctaaaacccgcatccggacaccccagcgactcaaattgtcacgtgaatcgtttgcctcagggtttgaaacaggggggcgtgactccgggacgtcaggaacgtctagtgcgccggttgaggcagtgtcagatcggacatttcttgatatgcgcccagaatcatcaatatgaaaggcagatgaaaatagacttgataaaaacgttccgggaaccgccaatgttcacctccatgtctccgccaatctccaggtttactaaacaagaaactgcgggaggaaaacggaaatcagaactacagttggagagtctggttgcgggccacgtgaaggaaaatggagttgacaatattgtatttaacaagcagggaaatcgtttggaaaactcctcctttctccaacgtatctctatggcccagtaaattgaatcataaatcccgactatcataacttgacggttgtatagtaggatcaaaaagcacacgaatgaacaggcccatcaactcactccatccaatatcaggccaagaataggcacatccactagtttggtaatgttgcaatactaaatttgggaaataatcaccacctctgtaatctcagaaatgccagtatgccagtagatagaggcaagctaagagctggggaaatatatcattggaatactctcattcaaatctcctaaactttttacttttggagtcttgaactagtgtctgtttgattctaccgttctctgaatttttctcgtggttttggctggtacaaaaatacctgcctatagttctaaacgttcaaacgacattaaaacaagcaaacaacaatctataaccccctacttggacccctggtgccttcatacaaagccggaaacgtatgtaaggcactatgtaaggcactaataggagcacgcggaagtaatcttcattttgggatgagggagtgaaggtggaggaaataaaaagtagtgaaaatgagagggccggtcaaggggatcataataatatgttctgctagtttctgaaagtactacaacgtccacaattatacatctccttttcccagtattactccctgtaatactcccatttatacaccaataaatcgtagatacaaactcggttttcagtttgtttctggagactttggcaaggagtaggggaatcgaactttgggcttgtattggttgtttctcatggttttggtgaagctgtttggtcggggtggaggggttcgactgtttttctggatccaattcgacgaataatgactgtagagacatgtttaaaccacccttatgatacccgtcaaaatctaaacaaaactcccttttgaaaatcattctatccgtcgcgtttcgttcacaatctcccccaaagtccatccactcagaaccaagtcgaatctctctccaaaaccaaatcaaaccaaaaaaaacctgctcgggagaatcgggagacacgtgaccggatccagccccgtcgtgactaacgcttacagtcttttactgtactgtagtgtgtttttcggtagagttttacagggggtagacgatgggttctgggtgggtaggaagatggttttcagcggtcacatgacaatgcaaattgatccacaaacaccaccgtgacgacccctttcttggcggcgatccattggcagactctgctctccaattgaacagctggtcgcgtttttttgctcaaagttgcaagaggcgctaccccgctgatctacagatcagcagatcggcgctcagcaaggttgaagccagcagcagttgatagacagggtattttggggccgtcgatcgagatggaggggtctttggggataccagcgatccctgattgtctcgttgggctgatgtttttgtgatgacggcttgtttgcggttttgatcacaacttttgatccgatggagatagagacgcgggaagttgtgcattcgattcaggccactcggaagaacccgccgaaaggctggatggcccaaaagtctcagctggcggcggctggcagggctggaagattcagaccaacgtacagtcgtgcactactctaccccgcttggatcgacagagctagtgactgggcggggagagggaggtgacgaccttgctagttttacgttggagtacggcgggggaatgaggaaatggtactggcaagggccgtgtaactgccatcacaaatatgggtagtggctgcattgtttctgccatcaccactccacccatgcggttaccacatcgtccaagtactcattactccatccacgtggtcacccactcacccatgtcatcaccacatcatcatacatcgccaatgattcaatagccttgcagaagggggattgtttatccgtgttaacagtccactagcaggggctggggctgggctagccgcgacgaagtttcgggatacttttcgagctagattatgacgatttgcggcgctaagacaagaccgagtgtagcagccgtatctctggttgccgccaggttcttttgggggttctatggcaattagagcgggtgaaattgcttcatcagggcctggggggacggctgaagtgaaggaacggcatagttgtctttatagaggcgatagagagaagcggagttgacgaaagtgatatatgggcgctttgtaatggtctggtaaaaagaaaatctcaaaatctccaatactgcccaatctggagacattccatgggacctcctgtgctggtcgtattactcaagtaagcttaactaattggggagataggctaagtaatacgtgaagtttgaggtctgttcataacgcgctagattggtttgcaaaagctcaattttgctaattgagacattggcaaggcaagaaggcgctttatacgggtttggtgtgtattaatggagcaataagcgttccaggaggattcaaatgcggttggtttgctcaactaattgaaaaatagagtttaaaaattacattaaaataaataataaatgaaatgaaatgaaatggaaataatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataaatataacaaagcggtgtcaatcacttggaccggcggcaatgtgcgacccaagacgagaacaaccgatctaatgttgtaggtatcggaccatttcagcatgcctggacgaactggtcgggtgttgacatgatgatgaatgtcagtaaacatcgtctctgcccgcaaacagccatttctgctgagacaccccaatcagaaagcatcgaacactcatcgagcactccaactcagaccagaaaacgccccaggtcaactccgaatgactcgatttgtgcaaaacgtcgatatagatcatatctgagattccaggaccaacggcagaaatcgttcctcttaatggccacaattggccaggtagggttaacttcattgaagtaggctccaaggaaatctgactagaagttccaccttcaatatcacacttgtagttggatcggaatgcggttttcagcagtgtttggccagagcgtttgtgaaataaaatacttgcaccaatgaccgcacgggaaacctttgctgaagttggatacagaattgtctgcgatcagtgactgtgagcaggtttagtgtgtccgagctttgaatttggtccattagtatgaggtttcaacgttggctggaggttgaaagtgcatccagatggtctggtctggtcgattcaggaggtgcacgtgctagtctcgccgatagtagatttctccggatctcgcactccatccaacctccatctcaatgaacggcttctcgagctcccaccttgacttgcagtctctcccacagtctcagtctcagtcaataccacctcttgacaatgtctcactcaggtctcacacgacgcaatgtcgcattgtgttcggagatctcgatacgaccaaatatcggagccacccagccacgaaataataaatcaggaacttatgacattcgtgtagagcaagtcagatacgagatacgactggagaagatgagaaagttgtccgaaagtgccaattagttgaccatctccacaaacagaaaatccaaaacttggttttccaactagacagcaaaacagttgctcctcatgggataccctcaaacaggacaaaaataagagggagaaaacaacaaaacagcaattccccaacgaaaggagtagcccaggcaacccaaccagagctcgaacatggtctcaccagccctcaaacattgtctcactatcccttgacgcaactatctgctgttgtctcacttttacaacgactcggatcgacgggatcgactcggatcgacaggatcgacatgggtgaaactaatgagttggagacaatgtgggttagactgagggggaactgggagttgggagttgggagccgggaactggaagctgggaagctcggctctagttcctccggttcattgttttagtctcatcgaaagtgggtttctgatcagtggacgaaagacaaatttctgagttcccaagtagttccaagtagttccgagtagttctaagtagctccaagtagtcccaagtgttccaggtagttccgagtagttctaagtagctccaagtatttcctcagtaaaccagcagctaggagttcgatgaaacaatccattgtgacgttacacttgcgagcctcgatcggtgttggaatttggcgaaaggaggatatcaagtagaaagctgcgatcattgtagtttgagtaatgtaagtggttcgagtagtctgaagattcaaaacccctgtcagtgtcagtagcctagatatcgcgactgctacagcgcagccataatctagcgctctggagtggcctagcccagaaatactcaatttacttgcatactcactactcggcatactcctgaaatggatctatgatcattcctccttgaagtagggagcaacgtccttgttaagacgctgccagagctcctctccgacacttcctcggcgcccatcgtcaacatccagtctaagatgacctcgaacgccccagggaatgagatgctcgttgttcttgacggcaggattgagcagtgcagacaactctgtgtaggctccgtacttaggagggtactgaatgtagctcttgagggtggagaggattgggtaatgtcgggacaaattggaggacagattgcccggatcgacggacacggagaccacgcccgagtcaggatggtgcttggaccacagatatgccagataggcgtctccgatcttggactgtgagtagagcgtccagggagacgggttcttgtcgtcctggtggttgatatcgtcgaatttgatacctccttcgtacgggctcacgaatgtgactgacgacgacaaccacacgaggcgcaccgagtctttgggggcagtttttgccgcggcgatcaccgctggagaaatgtatttggccaacagaaagtgcgagaccacgttgactccccattgcgactcttggccctgtggagtgagagagtagggcggggccatgactccggcgttgaaaatggcgccatctagagtcgggtacttggttcgaatgtactctcctgcccgttgcactgtggtcaagtctgccagatcggcctccacgaaatccaacgtgccgtgcgagtggtccttctggagctggtccaggacgggctgccaatcgcttctggaccggccaaccatgatcacgtggctctttttgtccagcaacagcttggtcacctccagacccactcctccggtggcgccagtgacgacaaaattcttgccgtcaatatccgggtagtccttctcagtgtactgcggttggcccacccagttgtttcgcagagcctgtttgtactcggtgaacttggcccgaatcattgttgagaaaaagtggtgagtaagagtctaagttggttgttgtgatgttagactcatatctacaaacgccagggaagcagaagagccgctgctggacgaaggagaggagatttagagactctgaaaagtggaatttgctcaattgcacgagctgaatctttgggatttgtcagattgccaatacgacccaaactcgtcaacttggaccttctgacccgggttgagcactgtcgcccaatatcgcaaccttctggtgcgctgaataatcggctcaccggttcgaatttggtacgagagcattccccgagacgcccgcacccagaaaaaccttcgccagtccgaatctatggtgtattcgtgggtttagacaacatcaaacacatctacaaacatctaactgcgaagtcaacggcccatcggacccagatctgatactgccagtatttcaaccatggatgcacaaccaacacctttagaccttgtactgctccaagacagcactgcacaagtacagtacctattgcatctgcttgtttcttcaatctcctcattcgtcacattcctctaatgactcttaatgccttcggttgttctacttggtccctctcttcatccgacattcataccaatgatgggactagacgagagaacccacaagacttggattgaagtcatggaatcaacaatatcatcgacgagctttcgtacatcacattgagacaagcattaaacacacgtgacgattcttgtcgttggaatatgttcacgtgactctctcaaccccagtcgtcatgggttactccaaaatccacttcctctcatcccaccatccgtctcgaataatatcacaatgcatcaccctcaccctccccatcttcttcatcttgcgctccacctgccgctgactgagccccgtagtgtcaaactccttcacaatggtcgttccctttttgaacacgtccggttcgttgttgtagttgagtccaaactcggtgaacaacagctcatgcttgtccttgctgacggtcttgctaagccgctgctcagcctcctgcgtagtcatatttccctgctgaaccaacgtccagaatgtcgtattgtacaagttgttgatatggcaatccacctgtctccacgaaaagtagtctcggatagattgcgcgtttggatagacgacacatcgagcgtcaaaagtaggaagcatgtgaatcacaagttcgtttgagcgagagtcacgtgagtcgtcacgtggttcagacttgactgcttttctctcctcctccttcctttcctcctccttccgctcctcctccttcatgtcctcctccttccgctcctcagtcgtctcacgtgtctcatcacgtgactcatttccgttgaaatacctcccccacaatgcgacataataactcgtaaacgtgctagcaaaggtactaaccagtttactctctcttctctcaaacagagaacactttctcctcagcagaaaagaatactcgtcggagtcgccataagccataataacatcatcaaattgagacacaatcagctcggcgcatttgttcatcaactcaatggctctgagatcgttgggcttctcaaaattgtagaactttgaaaacttgtgaaaccctcgaccatcaactcgaaccacgatatgacagtcgggaagaagatggttttcctgctcaaagtttttcacgtattcgtatctgtgttagcgcgtcgaaggggtttggatcacgtgatatctgaggagagaatcaagtgatgttccatgcgtgggtggtaacatccataatggtgcttgaatagacgagcgattacgctatgaaaagcaacagtggtatcgagagaatgacaggatgatacaggaaatgtttccgtcgtcactgcatcacgtgataacatcgtaatcacattctttggggaagctgggtttgagatagagaagcgttctgttcaatcgcgttattccaaacgtagggggaccgggtgagtgataatatgtcatagagtaagatcagcaaaagatcatgtgatttcccctcctggccctgctcttgacgtggcgttgtcactccacacagcagttcccagacctatcctgatcggtcgcgactgctccatctcacaccctccttccctcgagcatcatggtacttccatttaaccggcggcaggtctgtttgtatgatttttccatctctggatgtcgtccttggctccaactcacctgcttttcgccattttcgcgtggttctgcgatgatcaaaatttccaagatttattttcatctgcatatcccatgcagatttgagttgcgtctccaccatcgcgagggaaggacgctctgagtatgcgaagcagcttttttaccgttcatgatatcaaaatggttgcgcggatgtcacgtaggcgatccgaggagacttgacattgaactcaaggactctaactacgtttcgtgaggtttgtgcctggtaacaaggccattgagaggtatctaccagatgtcagatgagtcaatggatctgaccagatgattcatggatctgtcgagacttcaggtcaaaactccaagggttcggctggagaagtttcccttgactcagggtgaaaagatgacctttgcgacggttacggaacagtcttaacggagcttttccaactgtccttgaggatccgacatgcaccgtatggataccaacggccatcttcctttggagtcagtttctggagacctacagtcctccaaacgtcagaagggattacactgttctatcacttggaatatggcctagatgatacacatttgaggttttggacactctgacaatcagataggttgcgttctgccgggttcttctgggaggccctccaatgaccagactcttctctcgactagggagactcatcaggagagtcttcgcgctgagcacgtcatcaggttgaccaacttcagatgagtgagtgatttatccctcagctagtggttggaaggtcgacccgcgatcaaaaatcattcataacaactgccacaaagcataacaactgccacaaaacatgtcaacaccgaaggagacatttcattgcaatatccgccttgattcgccccaacggagacgtttgacttccagttgggtgactttgcaactgattctggccagagcagacgttaggagtaacataatgatgagagaaaagatatcaggatgctcctccagacattccgatcctggttctactttcaaaaatcaaatctgttcactattcacccacacaccgtcctttttcaagcgcacatttcaccattttgagtttcatagacgttggagttgggggagtctcaaatgggtaattggagacattatttgatgattcaaaagatgtcatcctactcatatccatcttcttttgcagattatgtcttcattgtcggtctaaaagcgcccccaagtctcattgacaacttctttcgccaccagtggagaaactcggctaagatttgagtttttcactttttttgtagctttggagatgtgcgacgaatgggccaactaaagccggtatcgcgattctgaaaagtgcattcttttggcaatgcaattatgactccagaactaacgttgtatttccagatttccctcctcttcgggtctttccagccccaaccgagactccaaccccgtgcatctgggacgcacggtggataaacttttcaaaagattttatttcactgcacatgtccaattttttcctcccaccactactaccacaacaagatgagtgaaacgaaaaaggcgtcgttccacacgctggagcgcgaggagtattttgctaacccgccagatgagcaaaagtacccgctactcagagacgccgtggcgccccacatcgggtcgttcaacgcgctgacggagggaggcatggactctctgctcaacctggcggccaaggaggttggcgagcgggtggtgtttgacggagacgacgagaatctgggcaatcggctggcgatccgggttgccaacgtgcaactgggccgacccacggtgtctgccaatgacaagaccaccatcaaccgaaaggtgtttcccagcgagtgccgtgagcgaatggccacctaccgagcccgtatggtgctgactctgggctactcggtcaacggtggccccgagaagtttgaaagcagagatgttggtatgatccccatcatgatgggctccaaccggtgtcatttggaaggcatgggtcccaaggatatggtggcccacaaggaggagagcgaggagcaaggaggatactttgtcatcaacggtctggagaagctcatccgtctgctgattgtccagcgacgaaaccaccccctggccatcattcgaaagagtttcaccaagcgtggaagcaactacaccacgttcggagtccagatccgatcggtgcgacccgaccagtcgtcccaaaccaacgtgctgcattacctgtccgacggaggaatcacaatgcgattttcgtggcgaaagaacgagtatctggtgcccgtcatgatgattctcaaggctctggtggaaaccaacgaccgagaaatctttgacggcattgtcgcctccgagggctccaactcgttcctgaccgaccgtctggaactgctgctgcgaaactacaagtcctacaagctgacctccaagcaggagaacctggcgttcctgggagaaaagttccgaatcgtcatggacgcccctaaggacatgtccaacgaagatgtcggccgactcatgctcaagcgggtcattctggtccacctgcaggacaacactgacaagttccgaatgcttctgttcatgatccgaaaactgtacgccctggtcgcgtctgagtgctcccccgacaaccccgatgccgtccagcatcaggaggttttgctcggcggcttcctctacggcatgatcatcaaggagcgaatggaggagtacctgagcaacttttgcgccacggtgcgaaccgagttgcagaagaagaagcaatccttgcatttggatgaccccaaaatcatgcagcgaatctgcccgcgaattaacgaggacattggccgaaaactgcattacttcctgtccaccggaaacctggtgtctcacacgggtctggatctgcagcagaccaccggttacaccgtcatcgtcgagaagattaacttccaccgattcattgcccatttccgaatgatccatagaggttctttcttcgccgagctcaaaaccactgacgtgcgaaagctgctgcccgagtcctggggcttcctgtgtcccgttcatacccctgatggttcgccctgtggtcttctgaaccatttggcacacaagtgtctgatttccgtcaagaagagcgacgtgggagacattgactctgtgctcaaccagctcggaatctctcccgcaggagccctggccaacaccccccaaaagtctgtcgtcatgctcgacggaaagattatcggatggtgtactcacgagattgcccagcaggccgccaacaccattcgacagtggaaggtgaccggagacgcccgactgccccaggatctcgaggtcggtctggtgcctccctctcgaggaggtcagtatcccggtctgtatctgtttgccgaggcctctcggttcatgcgacccgtcaagcatctggcaactgagaaggaggacattgtcggtccctttgagcaggtttacctcaacgtggccgtcacccctgacgagatcaccaacgtgcattcccatgtcgagtactcgcccaccaacattctgtcgattctggccaacatgactcccttctcagacttcaaccagtcgccccgaaacatgtaccagtgccagatgggtaagcaggccatgggcactcccggtgtcctgactcaccgaagtgataacaagatgtaccgactccagaccgggcaatcgcccattgtgcgagccggcctgtttgatgagtacggtttggacaacttccccaacggaatgaacgcggttgtcgccgttatttcctacacgggatacgatatggacgatgccatgattatcaacaagtctgcacacgagcgaggatttggccacggaaccatttacaagaccgaaaaggtggatctcaccgagaagcaaaaacccggcgaccctactcttctgcactttggttttggccccgacaactggcccagagagtggactcagactctggacgttgatggtcttcctctggtgggcgccaagctgtctaacggtgatcccattgccgcctactacgactccaactccaacaagaccatgtgcctcaagtacaagtctggtgagactggatttgtggaggaggtgaagctgctgggtgatgactccctcggtgagcttcagaagatcaccgtcaagctgcgaatcccccgatcgcccgtcattggagacaagttctcgtctcgacacggacagaagggtgtgtgttcgcaaaagtggcccacctacgacatgcccttcagcgagtccggcatccagcctgacgttatcatcaacccccacgctttcccctcgcgaatgaccattggtatgtttgtcgagtctctggcggcaaagtccggagctctgcacggaatggctcaggatgctactccctggcagttttccgagaccaacaccgccgctgagtactttggagagcagctgctcaaggccggctacaactaccacggaaacgagcccatgtactctggagtcaccggtcaggagttgagatgtgatatctacgtcggcgtggttttctaccagcgactgcgtcacatggtcaacgataagttccaggtgcgatccaccggaccggtcaacccgttgaccatgcagcccgttaagggtcgaaagcgatctggaggtattcgagtcggagaaatggagcgagacgcgctcattggccacggaacttcatacttgctacaggaccgtctgctcaactgttccgattacacccagaccagcatgtgtcgaacatgtggctctctcactgctacccaggaggcccaaagcaccaccggtcatcgacgaggcgtcaagtgtcgacgatgtgccacccagctcgaaaaggactccttctcttgggactcgcctcctgagggcatgtggcaggacgccattggcaactgctttgtgggaggagatgataccaccacggtggccattccgtttgtgctcaagtacctcaactcggagctgtcggccatgggtattaagatgaagtacaacattgatccttagtcggggttagaaaatggtttgttatggaggatgagatggttataattaattgatagatattaacgtagagtacaagtacagtacggggtaaattgccggtacggtctcaaacaggtgccatcgcacatgggtcttgcagtcggtatatcgattcgaatctagaccgcctctcttgatcatctaagagactgcggtttgctgttcgaggtaagagtggtaactggaaggtgatgaaacacttactagttaaactatctcttaattcccaagtatttcttcattaaactcagaattactagttaaactatcatttaactatcaagtaattctccattaaactcccaagtattgctcaccacataaactcccaagtttctcactaaactggcaagtttttctacacacacactcggattgggccgtcagaacagaatttgttatttcactgcttgaactccacatttggcccatcttccagaccccacattgtcttctgattcgaacttccctacttgaaggatgttccaatggcggcagatgtcgggtctctcgtaattggaaccctttagatacaagtaaaagtacctctcttttccggaatggcaatctccagagtgactttcctttcctgttggttccgtgctctttgccgggctgaagttgaacatggaccttccgtcatgttcctacaattcaagtctcatatgttgagaaagtcggaagtcgaacttgtacgggttaagcgaaaaacagtctcccaagtgtcattaatacagaattgattcaagtacagtggtatacaagtacttcggttttctttcagtatttttttcagtattttttttcagtatttttttttcttcgatcttttcctttttttaactgataaacaatcacactctataagctgtgcaacatcgtaccactgacaccatagtaaaatacttctatcgaaattttgataatcgaaaacacaaatcaaacacttgtccaaccgcgcaaccatccccaaaacactcctccacttttttctcccattttttctcattttttcccattttttccccatttttccccattttttcccatttttccccatttttcccatttgtttgacatttcttatatttaatttaattttttatatttaaattcattttatattcatcgcgaaacaaggtttcaaactaagcattatcaccactgcgggattctaaactagagcgtagttaagacacctctcccccaaaacacctctaccccaaaaccccccggctcaacttatttatacggcaaagctgcccaggcgtcgtggtgagtacacaagaggacgtcacgtgacacgcgacacggacacgggccgagctaactcagacatctttactggcgagcaacaaccgcccaccacaaaaaacacgacttttcacacgccactttttggctagacggataccagcaaggaggaggtgagtacagagtgacagagaaggggtgatatggatggaacttgtcgtgagcggggccggtctggctctggctctgttcttggtttcctgctaactcagactaaggctacttgtacgacagatacacaacagaccaggcatttttgaacggccaacaacgtctataaaccagtgacagacggcgttcgttacacaaaatgtgagtaatctatggaggttgtggcagattgttttctcttttgggggtctacgacgagatcgtcatggtatgagtggacgccatgtgtgtctgggatattgggtgtttggagctcagtgttccattggcggggttacgattaagcggtctagcggccttctacttgctcaggtacaggtgttggggttactgaagttcaaacatgacccttgatctggaacataccaagtgttcatttggcaactactacgaaaccccctcctcggtttcacatgatactaactcagggactcgtcttcgcgcttccaaccggaagccatttctggcggtgtggacttctcgcccgtctttctcatggacgtgatcatgatcctgctggtgtcgctgtttgtcattttctacttcaaccggctcattgcatgggtcacaaacttcggactccgcttcgtcttctggcacaaacataggatacgagtcaaggtgcaatcagtgcagatctcgctcctcggaggaagaatcttctttaaaaacctcacatatatcggcaccaaccagacgatatgttttttgaagggccatttcacatggcgttactggctgtggaagagccgcaagagtgagctccagatgagcgaggactcggaaagcaatgtgaccccggaaaagttgcaatccagactggctctcgaggtggatggccttgagtggtttgtgtacaaccgtacacctgcttatgatgctgttttcgagcagtttcaggcccgccacaaggccaacgccgaatcaaagtgcgaaaacaacgacaccctccaaacggcgcatactaccacatcttacgagccgaaaaacttttcctttggcgagcaaatatacctagatttgttccccattgacctcaaggtacacaagggcagcatggtggttggcaacagggacactcagagtgtgtggatgtttcatttcaagaatgccaccggattggtggatgtggcgcccactccttcctatctggacagatacagacaggtctaccgtgcggactttgagcatcctgtggttgagatgaggcccaatatcgactacaagggcatggactcgacgcagtttgagcacaagcccaaggtgaagaagagtctgtgggccaagacgtacgagaatgagcctaacactagcaagttgcggcgcagtctgcgggccattcgggctgttcttctcgcccgtgctcttcctgacaatgagagtgagcattctcgtgaagggatgccctggatgggtctgagtcggtacttgacgcaggacactgagtactatgtcgaggacgacaagaacgagggagcctttgaggattatgctcgagttcctcagattctcgatgctccaagtggttccttgacaatgtactacgatgttcagggacaggttcctcagattgaaggtgttggagccaaggattcaccccagtggggcatgaagatcacagccacgaatgccacgatcaactacggcccttccactgagcgacaaaggacagatctgcatcagatgctcattccccgcacatgcattgatgccgttccgtctcccaaacctcttccaggcgatttgcggccctatgagcaatttcgggtcgatgtggagttccaggaagagatgattctgcgagttccgatccgggaggaaagtaaaaatctcgagtttgccaacctgttcagagacgaccctggtgccaacacgaagcgcccgttcgggtggatggaaatcaagacaaacaatacggtgactgtggaggagattcagagcatggaggccaccaaggatggatgggctcataccgtgtctattaatctaggccaaaccgaggttcgaacgagtgtcaaccatggtcttttgttcaccggcgaccatgtttctcttgagtgtgatttgtccactcctctcgagtggaacgggctttgtgactggaagtttgatttgcagtcttcgtcagtcaaattgtttctcctcgacgaacacatcactttgttctccgatttgaccaatgactttggctctgacacacctgttccgtacactctgttcactccttacaagtacaccttccactggggagtttcgcacttctgcaacatttatctgaacatcaatgacgccaacattatcaacaatcccactgattttgaagataacacgtttctggtgtttgagagtgatgctcttgacatagacttttctcttcctctggaccagatccaccagtctctgaacgaggcctctttcaagatttccgctcctatcatggacttcaacttgtctgtgcctccctggcataccttggactcgtttctggagacggagaaaatggggcgagcctacgagtttgccattgtcggtacttactcgtactactcttcctttgacaaggagcacaccgattcgatgcatgtggagatttacggaacagatgtgaccatggttgcccatggaatctttgtgtgctacctcatgaaggtgattgacaactactttggcatcaacacaaagttccagaccatggaggagtatgctcaaagagacgctcccaaggtggtcgaccccgtcaacttcatcaaggaaaaaaacgatatggacgtggtggtcgatacctttatcaccaacggagtgattgtgctgccggcaaatctgtactccacccgagaatacttgcgtctggatttcccgtctctcgatatcgactgtcggttcaccaactactacatggacctgcagtcgaacattgctcccatccgaggtcgatgtgtcacagaggcaaccaccaaggcgtacatgttggcccgcgagtcgcattcccgcactcttggtgaggtccagcctcatatctacattgatggcattgacgtgcatggtcaccgtttgtttggtcgtccccctgaagaacccacttactactgcaagtgggacttccacttgggcgacattcagatccgaggtcccatgagtgctattgcagttctcggccaggctgccgactgctttgattacggctttgacgacacggagaataagcttctgatggcgattccactcttgtttgacgtcacctttgtctctgcgaagattaactctctgacattcagactggaaaccgatccaggagccgtggaggttcttacatctgctgtggccttcaaactgaacgatctgaacaattcggactatacagcacgggcctcagtcaagatcccctggatccagttgtctgtaatgaccaacgaagaggtgctttctcagttgaccacttctgttctcgtcaccgattacattcagaagaggaacatggatgaccgtcgaggcaagcaacaagagcacattcggctccatgacgactcgtttggccgatgtgactttttgttgactcacaagtatgccccagacgcaaagccatacaccatcgttcccactcttcctcttcctccacttgcagagccattgactgacgaaaacatcaactctctgggtacagcaggtatcttttctacgtacaagaagcgtgaaaactacgacattgcccaatcgtctttatcgtctgcatccaccaactcccaccgtctgagtatagacagcagtttcatgacccgaagcagtggcatttctcgtataagtcggtctcgaaacagctacaagattcgcaagttccgacgtccccgtattgagaacaagtttctggcgcccaaaccttggagaaaggcttccaaaacagccgtgtccgacattgacgtggaccctgactttgctcaagactttttcgcgtcgaaaatgcgacccggcatgtctgcatcacgtgagacacctgacgaagacacggagacggataacattgttgtgcagctgggtaagattggaggaacgcttactccggctgctctgacggtagttctggcaattatggcccagaccccgcaggacgggttccacgtgactttggataaactgcagatccaggtcatgaagaagctcaactacatcttgtctggacagccagagacgaaaaacatccgtgtggtgattcccggcgtggatattgagatgaaggctagtccagggggctcggaggagtacgttcatttgcagatgggtaccattgacattatggtacgtgacaatgtgcacaagcgtccccagtctattgaggactacattcaggataccatggatggtaatgagccgcgggagaacagcttgattgtgtatggttctatggacttgactctggaggttgtcaagagcagccacacgattggtccgtctcctaaccctctggttctgggattgacgcaatttgagttctggctgaaccaggacgtttccaactcagcctctgctcagatcaaggagctagacgtgagtctggacaaccagcagctcgagtggctgttgcggaacacagatcggcagctggaccgtctcaaactgctcttggatgacattcccaaccagaacaaggctacccagtctgacagaaccaaagacgtggtctactcgctggcattagctggccagcagtttgatatcacgtccgatccttcaactctcacgaagcctgcatacattatccgtctgtctcagcagcatgtgcgagcccatgattcgtggaagattctgattcggctgcgacacattctacagacggttcctgctgcttggtacgctcacaaagagaagcagctgattcatggcgactgcaaggtgcccgtggacgctagaaccaaggtcatcaacgtcttcaaaaagtggcgattctgggagatcaacagtatcccgaaaagttacttgtttttgcacgtgttccctcccgaaagcaagagggccattaccatgactacacgcgtgctggtggatgtcgacggtattggtctccgtctgctgtttgcggagtgcgagaactatcttctgtttgactacgtgcaggtgtatgtggacgtgagcgagggtgatgaccatgtgattgatgccgatgccggtgtgtgcgtggcctctatccgtacacatttttcgctcgagattgtggacaccattcagacaattgctcggtatgtggatgcaaccaagccctccagtgatgatgagactgaccaggatacgactagaccaagtaccggtgacgtgatcaagattgaagttcctcaatctcccctctcgatgtcaactagtatgatctctgacaagtctactacgactcctgagcccgataagtcggtctcgcctggcccggagaaggttgcttccaagtcacctcctatcagggtcatggtcaatactctgttgtcgtcgtgggtggtttccatcaaatcgtcggccatcacactgtctgtttctggccaggagtttctcaattctgtgtttgtggagaagacgggcgacgatttaatcaacgatgtggctgtcattcttactggcacttttgggtccactggaatggagctaattgccaccgagaccgacgagcaggtggtttcgtacgccatcaattcgacagcggcatctattgcgttcggcaagtccatccacgtgacttgtgacacgcaaaacatgttgcttacagtgtctcaggaccttctgacgctcgtgaaactgaccacgcaatttttcgagcacgattgggaggtcatcgataaactgatcgaagaacttagtggagaggaggacatcaaagcccatcacacacctggatcggcagccgccgcagcagcagacgcagcggatgagctgaaggaggagctgtgcgaggagcctggacctctcaaggatatcattccgttccttgaccgagtctcgtttagatactctctcacttctctacaatgttcgtccatgctcatgcccaactgggtgtatgccaacgaattccgtaacatgcaggtggtggttggatcgggcattgattcgagaaccactcttaacggctcgttcgaggtgggcgagcagatgcacgaggtacgaaaccactcttctggcgactctcagattgtgcttggaattgctctttcagctgtctcggccctcggaggatcggtcatcacagaggagtttgctctactggactgtgcgcttcgatttggcatttttgatgcccagacagtgtctcctagcatgttgacgaggtacctagcgtctgagaatgagcgggagtgtgttaagcagatgtctgatgccattgatgatcttcaggagatcctcaaaaagcgtatttctaaggggggtggggagaccaccgaaatccctgtttcttcaaagcagaatacccccagcacaccttcctaccctctccacttcaccacccagattctggctgacaggttctcgttcactattcccgctctagattcttctctttgtcttgagtgcgataaggtatctgctttggcgtacaattttgtcatgagcgaaaagaccaaggccattgagcatacagctctcactggagctgtcacccctgatcacgtacggttcctgctccagaataaacgtctgcctggaggtgtggctactcttgtagacttgcatattcgaatttctctgtacgaatacatcaagtctggcgagagaaagcgaggcgcagatatcgagtccgagttcattcgtatctgtctgtcttctccgtcactgctcaagctgatggagattctgacaaacattgagggtgacatttccttgcttgaatgggagtcggacgacaagtcgccaaagagaaagagtcccaagaggaagatgtcccgtgacagtgtcgactcaaaggtgtcacatgagtcatttgtgtcggctgagtccgaacccgctattgtggaggaggaacctgagtcacgtcaagaaacggcttctccagctattgattcgggcgatgatgactcaacatcatccgactctcctctccaaaactggcgaattcgaacgtctttcgagcaggtcacgtttggttggctgttcccaccaaactcgggtttcaacggtattgtttttggctgtgataatgtggctgttgtggcactttctggttacggtcagttgcggctcaagggtgtctacatcacaccagctcatggtaacaaggacacagactttttcccggacaaggtgttccctactcatgccaacaccgtctatcttcctcgtctgctggtcacgtttgctactcttgacactcgagagtatcatcttcgaatccttggtgaggaactcaagggtacgattctgccgtccattgtcgaaatcgtctcctgcacggctactaccatcaaacagacggttaaggagctcgagctgctgtcaaaggagcgcaacaagcggcttgaaaagagcaacagcagcgttcgggttgttgagccaaataccgcaccgtccgactcgtcgctgttgtcaattgatcattcctttgtcttcagagccgacgccaagttccagggagccgttgtttctctctggagtgagtctgagtacgccatggagatgtatgccgaaacgcgtcacatccaggcgtcttctggaggccgcagatcaactgctcgagtggtggagtcatctccagagctttatctccaggctcctgctctcgaggccaaggttgacttcagacataacactggatccgccaacaaggagctgctcaagtttggcgtcactgtggagcccagcagcaacactctctaccctcggatgattcctgtggtactggatattgtgtctggtatgagaacgctgctcgaagacaagagcgacaagcacaaggacctgaagctggatcttaagagcgagatcaagaaggtgaagattgagacgccccagccccagcagccctccaaggacctcaccttctccgagtgggatatcactgccggtatacaaattgagcgccaggagctgattatgagctgtgaaccgaccgcccgagtgtctgcctcgttgtcgtaccagaatctgtctctgaacatgacgactgtggatgccagtgaagagggtctcggaaagttcttttcattcacgtgtcggcttcacgagttcaactgctcgttgcagcacacttactcgcgtgagatttctgccatggtcggtattgatgagattctgtgcgtcgtcaacaaggacaaggaggtagaccctgcgttggcaaatacctggaacgttgctgtttcgatcgtcgatgtgattgcagacatcaacgtcaaacacacacaggacctcaagttgttccaggagctgtggctcagcgagatgcccgagaaggagaaggaggtaaaggtcaacacggatccggaacggttcgtcctcaagtaccaccgagccacttccggtacgcgaatctgctggaacgcgacagtttccaacgtcaaattctctgccgatctcggtcaatctatcggaaaggtaactgtcggtctggatcgattctggctgctcacagacaagaaggagcacctggaccagcacattactcttggtttcgagctcatcaagatccattcggacggccgactgggaggtatggtttctctggcgagattccggcttgaactggctcttctgtgggagattgacgaagatgctcaggtaacgccagaagacgttcctctggtgactcttgtggcgtctctggcgtctgcggagatccggatggcctttgactaccagcagtttggtattgccagtatcaagaacctcgggttcagtgtctccaaccagcgagaagtggcggactacctgtccgccattgtcgacattgaacagatttgtgtctttatcactgttttggctccgtccaacattctggatctcgttcagattctggttcgaaccaagcagggtattgagggagcctatgaggaagaagtcggggcttccaacgaagaaactccctccaaggagaagaaagttggccggcctcatcttctcacgtctgtggacgtttccatcaactctggaacgctgcaggtctaccccagcactcttctcgatactcaggtcctctacgtcaatctgtctggaacacatgccatgtttgtttgtgacacccagaagcgtggcctcgtcaagtcgcatctggagctgggtatgcacgagtttatcattgctctgagtactttcaagacccagatcaacgaggaggatctgttgacactcactgtggacgagtttgtggctcatactcgcagagccaagggaggcaccattgtgcggatccccaaggtcgacatcaacatgcacacatggcagtacgacaccaaccctactgaggtcaagttcacatactcgtccgaattcgccggcaaagtggacattggctggaactttggctcagtcaccttcatccgagaaatgtggaactcgcacgccaaggcctttgccagccgaagagaggcctacaagctcaactttgtggccaacccgtcggtgctcaaggatggcgagctggaggagaagctcaaggatgtggctctggatgaaaagtacgtctatgtggcgttggagcctcccaacattgagattccccagctgcgagatatgggcgaagccactcctcccattgagtggattggtctgcatcgacagcggttccccggtctgactcatcaggtggtgattgtgggtcttcagggcttggtcaaggaggttgaagttgcatactttacagttcttggagcgtaatgacggcgatataatggagtttgaggaagaagaagagaaagatatgagcggttgagtgtgggggacaaaaaggacatttatttatttatattattttattatttcaatttggggtgctccggcacacatgcagtacatactcgtactcgatcttggatcagtggtgtgtggctagaccattcataaatcactacaggacagccttgtgtatcacgcggtgcatcatctgtttctggacccttctggacccttctgtttgtttcttctgtctcactccatccaacttccacacatcgacgatgcagaaatcaggcgtggaaaacagaagtttggatcggtgatggtgtggagttgtagggaggatggagttgtagggaggatgaagggcgtggatgagtacttgaatctcgtttgaatctcgtttgtttctatgcaaaatgtgtcaagataagatgattagtcgtgtagaagaggagccaactaatagataagtatttcgttccaaaggtaatcattttccaagtgtaacgctaactaatgattgaagggatggggttttatgatggagttttaaagacatttttggagatgaattgtgccaaaaaagaaacatttgcttagaatatgtttgcggtctatcgatttattcatctacaatttctctagcatctttagaacaccgaatatgaacccccagcatgcttttgctcttaacaaaatgtcaagtaaagaagacttttccaggaaaggacgtgagttctgaaaatgggcagaaaaaaagtagcacagacacaaaaagtggaccttaaaagacatccaagccctaataccccaagcatctgcttctactcggtctactccctgggttgtatggttgccaccagacctgcctgggttaccctacccgatgtgaagcttgtccttcttcacctgcagcgtacttactcagcactcactggtttgaactgtacacacaccacatcaccaccctccaaccgtctgtttcagcatgaataacagcgtggaggagtttttggcgcagacgcagcgcgggctggacacgcaacagccgccgcgacctcgttcccacgactcgcgcgacaccgaacgagatgtccgagatcgagaacgagagcgggaccgggacttcagagaccgagaccgtgagcgagaccgcgagcgggaccggtaccgtaaccagcggtggcgtcgacgggacgactcggtggaccgtgagcgggagcgagaacgacacagagatcgagattatcgagatcgcggcgatcgaggagatcgaagggacagatacagcagagatggaggtagagaccgacgggaccgacgggacgacgatcgcacacgtgacagaccacgtgatcgagacagagacagagacagagacagagacagagacagagacagagatagggatagggatagggatagggatagagacagaggagacagagaacgggcacgtgaccgaacccgcgaacgagatcgagacgtttcgatcgacgatagcgtggtgcctctcgacgagcgtccattgtctgctcccacgggctgggatgtcaaggctcgaggatatgagcgggtcagttctgagctggccaaacgatcgggtctgtttccgttaccgggacgtcccacccaagtcaactataatgtgttgaggggactggtggaaggtctgcctgatcagcccacggaccacgagacggcagcaatgatgcctctggtggacacgggacccatcaacaacggtaagggatctgttcgacctgagttttcacgggtggcgcgaagactgattctgagtggtattcctgccgatcagatcgacacggtggccatcaagagcttcttcacagacttcatcgagggtctggagctgcagggatccaaggaacggattgtggacggagtttacaagcatcctcgtctccccgaggtgttagtggagttcttttctgcggaaatggcaaccttagccctggctctgtctggtctaggtatcaattactcgggaccccccattagtatacgacgaccgtccaactacatttgtcctacgccagagagaagcgaagtttcaagaagatcgctggacgaggagaaggaggtggcttctgtggtggaggactccaacacgaaaatcattgtgtgggatattccgttcaacgtagaagaggaccaggtgcgacagctgacagcatcgttcggtgagctttctgcattccagctcattcgacagctgccgtctcgggagtcggcgggcattgctctggtggactacaaggaccccgaggtggtcaaggacgccgtttcagggctgtcaggacaggtgattggtggaaagaacctcaaggtaatgctagcatgtgaaggacccacgcagttgtcgtgttcgtccaacaacgggttgaagggaattgtgacggtcatgaatgacgtcaagagccggccggagtcgtcggtcattgttctgttcaacctggtgactctggacgagctgctggatgatgtggcctacagagaaatcaccgagcaggtcgagtccgagtgtctcaaatatggaggaggagaagaggtccaaatcaagatcccacgacctgaccccgaggccatgaaggcgtcgtatcgacggctaatctttgagactcgtccaggtgtgggaaaggtttacgtcaagtttgccagtgtggaaacgagtcgagtggcgatgcagaagttgacgggcctgcggtttagcaggagaagtgtcattgcgagttattactcggaggagtgttttgacatgaatgtgttttagatagttgagcgcaacggagagacacttgttccaggactctcaatcggagcagtggagtgcgaacgagctagacattgtgacgctctctactctgatatgaaggttcatctatcattattgtgtttgtcatcatggattttggctggattggatataatgataccgagtttccttcggggttataggtctttacattaattgtacatttgaatagttggatttttgtataagggtatgagcagcaagaaagcaatttgtagaaaaatgagtaggaagagcgcgattttcacattgtcgcagttctgaacactcgtggaatgtcaaacaaataattaaaaataaaataaaaacaaataaaaataaaaataaaaataaatcttagattattgtgttttttatttaatttttttattataacataatacattaaactctatatttaataagacaagtactgtactgtagtaaacgctggatgtgatcgacggataactctgacccagctctctctaaaataatgcgattaaaaataaaaatgaaataaataaataaataaagatcaataaattaagataaataaataaagatcaataaataaagataaataaataaaaagacgtacacatagaattccacacgttgaacatgaaccacgagagaaacgttgctcgttctatggtacagatactccatggtccaccaaactctcagactcgtatcgaggcataaagttgagggccgagtcagagatgcaacgtctcccccaccatcaaactcagcccacagacatgaccctactccctcacgctaggttagcaaggtggttgaaaaaagcgaccacgttcagatatcacatcacgattgttttcttttgtcgttgagtatccccatgttctttgtaggttggctcttcctaataccataatgtttttcatcattggttgtgcggatcgggtctttctccaggtgtacttaccgttagtttggggttcacagaatccaaacagcgtaccacccgctttatataccctgactttcggggcaactggcgcttctgtttttagccaccgatcgcaatggcgctttctattggaccgccctcgacttgcactgcaccgcaccacatggcaccaaactctgaaaccatgctggaggtggatatttggggctgggagcggcgtttggagaccgtgaggttgcctgaaacgacaccgagggtccgccggtcgtttttcgccgtcttctggacccccaaatgcccccaggtctaccccggatcattttacttctcacacgccccctttgctttcatcatgttgatgcacgcaaatatagtgtttggaaggaaagaagaaaaaaaaaaaggaagaaaaaaaccggaaaaaccaataaaaaatgggaaaaaatggaaaacttgcagactggaatttacgtcgatgagatgcgagaacccaagaatcagtttggtagtcaacagagagcatttcaggtgggttgtgaagacgtgaatatacgaagatacgaagatacgaagatacgaagatacgacctcagatcacgtccatctcactcattgcctgaacgactggtacattcaacgattgtcaggtgtttcgtcacaggcagggtaactacagagaagtgtatgctacagtacttgtagtagggttggatgaatccatgagaacgaggactgcatcagagatactggtggtgctaatactccaccttccgatcatgtccagtaaacgcgttgtagctaagtcaagtcatgaagcatttcttgtatatcataaataggtatgcacggcgagctctgggcacaataccgtggttgtatgtgcagtgtgggtcgtttcagtcaacgtcctacttgtaggtggtaaaataccttgctgtgaccacttcttgtctctcgcttctggcgacttgtctcttggttcttgtcgctctcgtctcgccttaaatggtcttgacctcctcatatatcgcctcgtcatatggatgcctcaccaacaaatcatacaagtcctcgggcaacttggcaacgaaactcatgcccagcttgataatctcctgggctcgcaatggaggcagggaccgcagaagagacatgggcgacttgctctccagcagcttgtctcgcatgagattgacctgcgcaatcacaaacaacacgttcatgtgaaccccgtaggcaaacaggaaatcccacagcacgaccacctcagacagcggcggagtgcaagcagatagcgtgagcaccgatgcaaacgcgtacaactcggccttgagcatcttggagttgaggtacttgtaaagagttgggtcaatgatctccagacacttgtcgatgagggccagagcagaatgcactccctccagagtgggttttacgtagagagggcagtcccgagacaacatgacgtccagcagattgaatgccattgcctcacttttgcagacgtacaggaacggggctgcgaggacgttcataccttgaacgtactgatctcggtgtgatttttgcaggtggtcaatgccctcttccagactcgccttttgctcgcgcatttcatttttccatgcgtatgagttgagaactcggatgagcgcgtcttccggcaccttttgcttgaacaccgtgtctgtggccattgtcctgaacgtgtcgtttcggatcttgccgtacatgggcgaagggcccagcttgatgagtctgatgtagtcttcagcacgggtgggaggcacctggagcaaaacagaccacactgttgctcggtaggtgcattctgcctggtcgttggccttcaacccctccaccagaacgagatatcgcaactgtccaagtgagctcttgagaatgatgggagtctttgataggaagttttcgattgtatcttttcggcgcgagcgcggtttggtcggcgatttgcgctcgctgaacgaagatatgctggacgttttgcgcaggtcgcgttccagcttctccaaactgtctcttcgtgacatgtgtgagctgcttttgtttggggtgcgtcggaggtggagatttgggccacgaagctggttgtttgaagtgggaaattggggatcggcgacctggtagtcggtgactttgatgggatcgctttcaggagacacgaaggctgaactggatggggttgcgggtgcactggaaacatcaccagtcgccatgtttacaagtagtgcatgtgcatgaatcttaatctctggagtgtcgataggggttgaggaggccgctgggggccggaaaagttgatcgattggcgccagattcgaaaacgagtatggatggaccttctggggccgcattttcaagtttcagaccggtgcacggtcgccggcggatgctgtgtgctgttgtgcagagactttttagtagtgtaaacactccaatggaagagtatgagcaaagcactgtgagaaccaactggtgcgtacgatagcgtggaataatataatgccggagctcgggaaatatggctttgacttgattgctggacccaccaacaaaatgagctacaggtacagtacaagtacagacaagtgtcgctggtctcaccaaaaagtcagtcataatcacataatacattatcgtaggctcgtctagtcacctctaatagttctacgtacagctgcggctgtattgtttggatcaagggaatgaccccaaactcatgggccaacatctactgctggtccttgaagttgaacggagcataggcgtacccctctccctcgaaaaacttggacatggcctcaacccagtgcaatctgagggaatgaagcatagcagatgttccttccatcatcaccagaatgaccaccgtcagaacaaaccacatggcaaacatgatcacaaccatggctacaccggcgggtcccgtgggtccaaaggcgccctggatagtcatgtcccaaagcacagtagacagctgggcatgagccagagacagagcccatagacgcaggtaggaagcggtatgcgacacacagttgaggcagaactcaatggtatgaatcacctggtggatcatcacctctccaaactcaaactgctcgtgtccctcaccttcctcttcaaactcctcaatggtcatatcgaacgagtctgcgtcgtcgtcagtgtcaccaatatggtaggcattgggctgtcgaatggcgtcatattgtgtctgcttatgctgtcgtcgcaggtagagcggcttgagaaggagcagccacggaacacagacaagcgcaataagcaccagaatgatctgcacaaacttttggccgggatacagaggagcatcgatggtgcctgggctcaaaaacatgttgatgagcatgttcagcagaccaggaggggtcttatccttggcaatccagtctacgcaccacttgtacacaatggtgagcgaaaggtaaccgaagatggattgcatgaacagcaagccaggtacaaaattgccccaaatatcaatctgcgagttgaagaacttgtagttgaggaaagagaagaagaaggagtagctcatgtgggtgaaacccatgagaatcgacagcttcatcttgtacgagtttgtgaacagcaggttgttgtctgttccatgccatgcgggatccaggccaaaggggtagactcccgtttggtgggctgtgatacgctctttttcctcccagctctcaggccaggcccatcccgatctgaacagtgtcatactcttggaaaagatatcgttgtacatgagacctgtgtagagcgagaagatgcccatcagtagcacaatgtatctgcccgagaaggccatgtcgaagatttcgtctcggtttcgcatcttgagaatgctcttttccttgagcaccatgacgagtcctgccagggccagaataacaccatgacccaaatcaccaaacatgatagcaaacatgaatggaaaagtgacaacagtcgccaaaccagggttgatttcctggtacgacgcaataccgtacgcgtcgacaatgagctggaaagccgccgtgaatttgttggttctgtggaatgttggtggagtctttgacgttttgatttcgttgagaatcgaattgatggccactccggacgacagagtcacatcgcggagcacctcctggacggctctaaagtccgccttggggatccatccctcggcgatcagacatcgacgggtctggtcgtagttgaacatgttgagagtgtggtagatggccttttctttgttggccagaacctcccagtggggcagagtattggcagcgagagccagctcggtcatgagcgcattgttagtggatcctaggacgttgtccacgtccgcaagcttgatgtttagctcttctacctgttctcgtcgtgtatcaaagtcctccgagacagggtacagagtggcgtccagggtgagggcgattcgcttgattttcgccagcagcgactctccgtgtccaaagacaatgaacacgtcctttctaacgcccgccagcggcttttcgatcgcctggtgtcgaaaatacaggtttccacgcagagatcgccacaggatccgctcgaaaatggcggttttggtcgaggggatgactccggtgacaaacgagagccccgccaccgagttccaggtgactgttgcggcctccacgtctggctgagggtcgtccaggtcgtacaacaggcccgctcggtcgccctctagagacgctcgaatttcgtgtctgttttctctggcgtctgcaaagaagatgcctgccgtctggaccatttctcgacgttccagaatcagcgcacgcttgtcaaccagctcattccaggttgtgtccaggtgtcccacgcgctcctccaaagccccgacctggtgacacatgttgtccacctcgtccagagtcggagccgccactccctcgggctgctcatcgattgccacgccatgcttgtcgatatgcgcccgcaggccgcgcaattggcgctccacgccgtccacgcggcgaatttccttgatgaaggaccgctgaaaaacgttgaccgaggtgttgaggtctctgaacatgaccacgcccaactctcctagagccgcaaccacgtctcggccgatttcactggccacgtacaattggaccagcgacatttcagccgaccgaaatatcgcctcacgttccatcgcagctgtttccatgatggcggtatgagtagatgacgagaggatgatatgccacttgtcaaccttaacattactaagtggcagaggtctggctgcatggacgaccgactgcaagagaccaaagatgcaacagggaggagtcccagggtggtacaaatgttggtgacgaccgtgctacagcctagtcacatgatctcattggcttattaataccctttgctttcgttgcaccttcaaaaccccgcatttttcaccaccaccaacttttcaccgcttcttggcactacgtgtacaatcttactctagggtcggctccgcggcttatcagattctttccgataagctctgggatgcagcttggggtcatcttgtgtagctggagcgaatggtgtccgttttcgagactttttttgcttccatttccgcccatttcgcgcaactcgtgaatcatatagggcccttacttttgatgcaatcttacaacagtacgatacgactgtcggcgtattttaatgttaaaaattcagtatgaaatgaagaagaaaaaaaaagaaaaaaaactggataaaaaactggataaaaaaggaaaaaagaaaatgttggatgatacttatatctagacgggaagtgatcagaggagacaggaaaatgtatcgtcggaatccccgagactgggagaatcgatttccgttgtcatatttcagatgcgacggaaactgcgccgttcagctcctgttcttctctcaaattgcaactcccaacagaactgtaaagctgcgagaaaaaaccgtagtgcaatggaagtagttatgttgcaaagtacagtttgtaggcggtttgggtggcgggtgctggtggcaactgtatgtgtggatatgagtatgagcaatagtttttggggatggtatttttttgcacgttgcacgtgactacttgtagttagtaagtaaaccagatttctgtttcacctcaatttgttcaacaattgactctcagcgtcagttttgaaacacgtgatttccccacagacgatattacgtcatcacacagcccgcactaattataggtgccttctgcacgatatacagtcccacaccaggcagcatcaaacagacgcggacaggagggatttgcccggaattaagtcgcacagacaactcaagccgatattccagctcactgtcttacccagccttcccaaagtaggttctacgacagggcccaaaccgggagactcccacaacagactctcacaacagactctcacatcagactcaaccagacgcttaaaaaacgagcacagcctcgactggtgactttggggacgtctttttattgacccatttcgcaactggagtcgatttattgcttttccgacaaaaatgcaccacatagtggcccacgacagagagaaggaacgacagcatgatttgagggacatgatgcaccgcacacactctcgctcgacgtcagcagtgagtccagacgacagcgacaagtgtgtgactacagaaaagaaaacatccaagcgaacgcttcctcagggagaaacggtgcggtatctgtttgttgacttcaaggcattccattacttgagacaagaacagcagtgcagcctggtgagcgaggaggcagtgattcatggctacgaatcttacatggtcgagcagtgggtgtgtgaacgacgaaaagtgaccgtcatcacatcatacaccggaaaccagtccaacaccgtgcgtgtcggtgtcttggccttgcccagaaacccctcgttatggaccccccgaactaaagcgtatttcgacgagcttctcaagggctatgctcgagctaaggagaccgaacttggagtactgtttgtgacttcgttgtcctcgttcccttccttcttgaccctggtatccgtgcctggcggagacgtacgaaagacatgggagtatttcgatgtcaatgagaatctaaagcgaatgggctgtggaggtcgagcatcattggccatctgtgagccgtccggaactgctgcggccaagttcaagaacatctacaagatccatgacagtgtgcccattacttttgctgccaaggaattggtggttcttgtgcagctatctctcttctattttggagtactacaacccgagtattgcgatggccttctctgtaacgaaacagttgacgccatcaacacgtggtgggatatgtggggagtgcgaaagtacaacaccaagcccaaagatggtgttttgggacccacaaccgttgctggtttgattgggtttgtgattggagtccgaaaccgaatggcctatgtgctcaactccaaggtggcgaaagatccctttgattgcgaggggtttgttgctggcttgagtcgatttcagaaacacgaacggcttcccaagaccagaatcatcgaccaaagaaccatggatagactctacttgctcaccaacaagggcagttataactccgatatcatcgatctgttcaaatcgtccatcaaggaagtgtctggaaagcagcatcttcatatgactgcttccgagacgttcaacctggagcaactcaccaagtcgctccagggagctcgatgcaaatacctctgggctggaaagggccaccagcgaactgttgatgcctctcttgtatccaactgcgtaggtattcccatgtcgtctgctggacataccgaattggcagctgctcgagatatcagacgagttatccgaaacccagcctcttccacaaccacttcattagtgtcaaccaacaacaatattcctggaggtgcagacacctctcgacgggccatgttcaagctcaggaagcccagagatgtggttgaagtacctccttccagactttacagaggtattcgaggtagacttcgatcaacttctcctaacgactcggtcgatgacgatatcgctatccgaggccacagttcgactcctgagcttgaccttcctctcgacaacatgctcactgatcgtcttctacctcaggaatacagagatgacagcagtgacgatgatgacggtcaccacttgcgccctggtcggcaggatagcatcaaaacgacgaaaacgaaccactcggctacgtcgtttgacaacagcaaccctgctcttcatttccggcgacgatccaagtctgtggatcagttccaccacgagctgtctgttcccgagcagctggaaaagcaccatcgatcagttatgcgtcgaaattccttcagtctgattgagaacttcattctccgccagcccccggagaaatcctttgtcagtgaaaagcgtatccggcgatcgtacgaaaagtcgcaactgtaccatttcctcttcaagcgtcatgtgaagaaaatgcgggatgtctgtgagcagattgaccaggaaagtcgaatgctgggcaaggccaagatgcgagatgacgtgctgttcgacaagctgacatcgtatctcaaaaactcatacagagaagaggctcgcctcaaggcagctctacacgaggtcgaagtcatgagctctcgaatcagatacgagtccaagatgctgcagtccaaaatccaggacgtggaagagaccatggaaagttttgttggtaaggtccagtcgctggaggaacgagtccagaaggcctcggctgctcgaggttacggctctggagggttcaatgtgaagaagtgcgagttggaagagaaccaccatgaaggacacaaggccagtcccctcgagactcaccgacctccccccctcaagatccccaccatgaaggtggcatgcacagaagttggtaagggggggcttgccaatgccggtagtggtgcgagcactcccatccagagtcctctgggagatatctttgaagatggacctacccccagcagtctttctgctgttctctggcccgatagcaagcctggagaggagggtttggttcagagactgttcaacaagctgtgcgagttggctggatacgagaccaagagtgcgttcgacgccaatgccgctggagagcgagtttacgccgagtaaaggatgaagcctgagatgacaatatacatatttatagaccaattaaaacgtaatacaactactctgtacagaactgtaccagttttaccgttctccattctattactataatacattaaatataatcgtttcgtcgttatgtttgacatcgttttctgcacaacacagttttggggcgttctcttctccacaagaagggggagcagagaacggttgaaatatttttttgtccatggcaacaaacacctattcaaaagcacctgtgccggtagatggcagttgcatgggacttgaggtccgagggctcgtcagtgtccttcacactactgagagaaaaagtcactggggtcatccttaccctcactgctctcgttggcctggatcagcgcccgggcaatagcaatctcctcgcctccgtgaacatgttcctcaaaggcgttctcaacctgcggatcaactgggatattgtcgtgtcgagtgagctgctcgtcctggttgtaggacgccaggtccacgtcaaactggctcatctgctggttgttggaggctatgttagcagcgttctcgttctcacggttctgagcagccaccgaagccatcagctgctgtccatcttccgtgtcaagacccagatccgcctgaaggcggccaatctggttcatattgtatccaagaggcatgtgcgagccgaggttcatcattccggtgtttctcgactgctggctctggtgctgtgattggctctgggtctgctgggtctgttgcgtctgctgctccgaggagctgggcacatgctgatgcacctggagagcagacaggtcctcaaagtcgtcctttttgattcgcttgataggaggtcgtgccacttctctgcattcgacacaatttcgaatagcagccgcaacagtctccttgattcgggtccagtggtacgactctgtgatgatcgacgtactcttgttgataccagcatggctctgtttgtggacctctgtggcgatctggatctgtcgttcagggtccgaaaccacctcccggtccttgagcatcagcttgccgtctctcagacggtagtgagctgccgaagatcgcagtcgagacttttcttgtcggtctgactgaggaggatacttgcctgtttcgaggtagtacttgatcttatcgaaccgaagttctccgatggactcgtcagtctcctcaatcagctcctttccgtaaatcaaagcatcaacaggcccgttctcattatccttcaggtgtcctgcgcccttgattcttcccacctttttgaaactcaacgcatcgaaaatcttgcgtgctgccacgttggtttcgtaaaccagattgaataccgagtaggtgtatcccagtttgggggcccactcgatatagctctccaccagagttcttccgatgccctgacctcgaattccggcattcaccagaaagttggcagtgcaaatgtggcagctgcggccagggtagtttgggcggatgaaaaacgagcccaggcactccttttcccacgcccggtcgtcccgaatgagcggctcgttgccaagcagcatgatggcggaaaaggtcccaaaccaaaagttttgaaagtcgtcaaactggatgggatggtaatgggggaaagtgtcgccacgctcaagctccatgttgaactcgtcaaacagaaagtactgtaacgtctggggcacagactgcaggttccggatggggtagatggtggcggtggtgacctggtccttgagcaccacggtcagaggctcgacctgggcggccgagtccagattcagctcgtcgccacgcaattggatgggatgcgacgtgtcctcaaaggtcgtcatcattttgaaagcgggtcggttgtgtgcgggttggaaagtggtgatgtgatgtgcttagtaatcagccgtgtgatgtgaagatactcaattgatgtgtgcaagacgtcgttactgtcgccctatctctgtgactctctcgactggccgaatgtctggtcggagcactggacgggttgaaggtctggtcgtagactcaatataggcgcctcgtatatgtcgtgtctggctgcaattgccggtgcagtttaaaataccaaaaaagaacccccagcctgaaagcggagtaggaaaagaccctgtggcaggtgtggttttccggttcgggggagctggaagctgcgtggatacgcgtgggtggcggggccgagatgctctgacgcgtcgcgtactgtactgccgtttgaaagctgcacactggctgtttaggggaggtgtggtgtgtgctgagatattctgaggaggcgagaaattttgtccgggttacccggtcgagatataacgggtggaacaaatataaggtttccggaagtttaaacggggggactggtacttgggtccgacaatgtcttgaatgtgatattatcggcgataagaggggacgagagtggttttttggtggtttttaggctcaaattgcgacgttaatctacttgaaagtgctccagaatgtccccaaatcctccaaaatgccccaaaaccctccgaaatcctccatcaatattgtagctgcaagtgaccaaggttcaccatttaactcttccaacttcccagctgcaggttgccttttagggacaaaaattaatgatcggtccatgtctcagagtttttctcgaacggcgtgttactaagccgtactgtacggtagtaggtgggttggagagggaagagatgacatgaaccggttttcagtggagagtatcttgtgcgtggcggactatgatttgaagacagtcagtagctttcgtatcgtgtgtatgtctgagtttccagggttattttctatccatctcgtataacatgttctgttcagcgtttgcagactggctcatgctgcaactgctgtccgagtagccgtctcatctgcgcatgctgaacttgtatccacaagcgtttgactggaaagtgcatctagtgtgacaatgtctcgatattgtgctattacggaactatggtacaagtacttgtagtacactcgattcaagatggtgcagattatgtgggcaaacaagacgagatgagaccatggtgggctagttggatgtcagtttcctcaaccataacatgccgtcgccacagtccatcttctccgcgttcacaggcccccgtcaatctccctcaggctccctcaagccgccgtcaatctccaactgtctgtctcttccacatcgagctttcttccataaatcaaagcgtcaacgggttcgtcaaagccgttgagaatagccgctccggggattctgcctaccacctcgaagtccatggagtcccagatcttgcgagaggccgtgttggtgacaaaaaccaggttgaacaccgagtatgtgtaccccagccgaggacccacgtagatgtagcttcttcccagcgcctttcccactcccagaccccgatggcgaggattgaccatgaatcctgcattgcagttgtgtgaacaccggccagggtagttgggcctgatgtagtagtggcccaggagacattcagaccagtcgctgttcgtgggaagctcagtgcctctgacaagaagccctacccatccaacgaaccagtacttgacaaactcggccgagctcgcaaacggcttcaactgcgggtatgtctgtccatcctcgatttccttgttaaattcattaaacatgaattcaaccagacgctggggtaacttgcccgcctcctcgtacccattcacaggcacaatcgcggcctgactgccatctttcagcgtcacggccagtgtctcggtgaatggcctagttggcttttctatacacacggtcattggtttgtgtgcaatacaagagggagacacgaatacctgtcaactaacgcttcgtcccaagagtcataacagtagttcgcacccaacttcctatcgtgacgtattgagaggagtgcgccgcgtgcatatcggagatattaatggtacacgaacgagctgagggaaaaagctgtagcttggtaaaatatattattgtgtagcaggagttacacagaagcaatataccaaataaaatcacatatttctttccaatcacactagttatggcgattcggagtttgtcgcaaagaaagcctattcgtgtgcggaaggtcagcgcgatagcacgatagttctagaagatataatacgacatggtactgtatgtacaactgtgtctatagatgactctctctcaagtcctcgcttgagttcactgtgcaatgactctattactggttggcgtctattattaatgtacacttgtatgtctatgccaccttcagatggccgattcactctccccctctcagcaacttccacagtgacccaatatcaattctctgctctggcagagtcgagtacagtagaatgtacagcctgtttctctgaacaggcacaaactggcctgtcagcagccgcttgataacccttacgctgaggtaatggaaccggattcggtctgaaagaagcgaatactggtagaagatcttggagaagccgagagggatgttctgcagctccagagtgaccccattggccacgaacttgatgccccctggcagtctttttctgtctttggctcttagaagcagagcaaagagcggaaagtggttcaggaaggccagaatggtttccaggactgcggagagaatgatgatggacagccgggccaatgcaaaggctccgtagaataccatgactgtcggcaaaagaaagaccaggactgtgaagaagatggttcccatcagaagctggtcgagatcatagttgcaagagtcgatacggtgtctcagcacgttctgacgcttgcctctgaacaggtggaacaacgaggtgattactcccagttgccaatggaagattttagctgatgcaatgtagaatgcgtaaatgtgcagcgtggtaaaagagataagatcacatagcacagagatggtcagagtgataccaccaacacgagagatgacgcttcccagagctggcatgtagggcattgcggggatgatgagaccatgcaccactgttctagaccaaaagtggatcacccacagcagaaattgtccaaagaacttggccaactcggtattgagctttagaccagccggggagtccatcaaccagataatagttgattctgggaatgttacaagaatgtaactggccaagcgaggtccattctcagctatccaagtctggttatcaagtagataagcacttagagcgaatcccaagatgagatcgttcaacacaagccagacggtgttgtacattcgaatgtattctggaggaacgtgtcgcttggcagcacttccatgtccactttcgctgatacgacgttcaatggcaatgtgactaggtgactgggtatgactgtcatggcctcgaatacgcatccactgcactggcaagtagcagacttgctgtagtctcaaatcaagctgaatggctgtagctgacgtctgtttaagattctttccgagcacgcggaactcgattagcagcagacatgcctcacagaagattcggatccccatgatgaaatatatcaccagattcgtgaagagcggaatcaaggggttgacgagagtgcatagaagcgttgaaatcacatgactctctttgttgttgtgtaccagtttctgcaatcggtatgccgagttgatttgtgcaagaatccgttctaactgacactctggagcaccaccttctgcatggactgttccgttcaatctcggagcttcggtctcttctgtgtatgacaaaacccccaactggcagtccccttgctcgtctgtcttctccagggtttccaccacaatctccttgtcaccctccacgtagtcgtcacccccaaactccactcctccatgctgtaccaacttgtccatcaaacactgcttcttttgctgttcgtgaaccagttcctgctcgaattcctgcgaaatgacccgcattggcaccgaccagccgagaattcccaacgaaatcggatctgtgctgtaaaactgcatccgctgtggatttggcgtcttgtatgtgattatcgtcacgtcgggaagagagcatgttaatggactgtcagcggtgtaggtgaaaggaattagatggcgtgatggcgtcgagcgcgactcattcttggtctcacgtgacaagtcgcacagatcacgtgccttacccacatatccaacaatctccaacccccgtttcctggcgacctcgggcagctcgacacatgtggctatgacaacaacattgcagccgtcgttgcgccagccaatgactaagcagtcgtcgtacctcctcccgcgcatcacgtgcatctcttccagcggccagaacactctcattggggtggtagatccgttttcgcgtggttcgtcgggtaaagatgggtccatgttgcgggacgtgagaggtgcagttgacatgcacacaagtgttaggctttgtagataaaatattaggggaaattttgggggtacgaaaagaagggtttgggaaggggtttcgagagagtgggagatttgtggtatttttgatgagattctgttcacttgtgagttttttcagatctattataggggttatagcgtgagacaaaagcggttgtttgttgtaactgcttccaagtattccaaagtcctacttagaagtatagttagttcttagtgagcagaagttgaggagtggagtgggagtcatatccaaaaaaatatccacgacaatttgctacaagtacggcacgaaaacaagtaacgatagaagttcttccagcttcgaattctgttgcaattattcagcaattcaaacaaccggaaacagcttcttcattcgtgtttcatctgatacattcttgcaagactgaaacatgcgaatcttgaaaccaagtcttgatattgatatgatccgagtatgtagttggcctagacttggcggggagtacgagtacatactcttcaagtacccacctctcgccagatgaacatcgtcgtcgccacagttgtaatcacgtgacagacccaaaacccccgggccctcttggtcgcctgaacgacctctggatcgaccgagaggcggaattggggtcggatgacggcgggctatgtcgacttggatcctgtatcctgtgttgagggctgtacgaggtagtcacgtgagaagatcgtaccgagaacaatccgttccttcatcttcagggctatgtgacattatcagctgtcttgggcagaccgacaactgtcgtattttttattttgcgtttttcgcatattcggcaatcctgtttgtttttgaatatttttttggttttttttggtttttttcggtttttttggtttttggttttgtcctgttttgcccttttttcctgcactgccccccagatggcactcttaatcaccttgatgtccccacatacggacggaggctaagaccaagcgtcgtccgacaaagcgtcgtccgacagagcgtcgtggcgagcgtcgtggcaggctctggagggttgcaattggcccattagtttgtgtccagaggcagtagacgactcctgatacgctcctagccctccgagtctttgcttggtggctcatctcttatagttgtcggtcctgagtgcagcagtcagaagccgaagctccgtgctgatatcagagttgaagacagggttggaaaagaaaatcagggttgatcaagcgatcttttggttaaagctacggccgtgaagaatcacgctaccgtgctgttagtcatatctggtggaaacggttggaaaagaaaagcatcagcgagttagcttatggttaatgcctgtgatccttacgaggacgagtacgagttccgctcgcttctggccaataatgctgctgtagatgaagggacttgacggtggagactgtggtgcgattccctactataccgtgtcttttgtttccataaattgtcccgccatggccccaatatgtctctgttcgggtttcggagtccgcgtgcacaagcgaaaaggcatgcttttacagagcatagcgtcggtggtcgcgtgccaagccagcaacgctgtttgttcctccgccaatcgtcttgcgggcgttaattgggctttcttagtccgctaagtctgcggctctggggctgtgcaagaaacgtaacgcctggttgggtttggcttgagacatggtttagccggagattcagggttggagagggaaaaaaatttgcacggtggccaggaattgcgcagcagttgcgaggtgcaaaatctgctggagccgccccttggcccgcacttcgcctccaactcagcctgcttcaggctgtgcatcacgtgcgtgtccacgtgcccaaccacggagggctatgcaccggttcgtattcatgtgctatcaaacatgtgggacgcatgttgacgaccagcaggagaaaaggcaccaggagggagaaagcggagattatgtaatcgcaagggccaagtgcagatactcaatttagacagggcagggtccgcgtccaatgcccgcttcgggaaccttgagaggaggggtccggggggtaacaactgcccacattgtcaaccaaggttcgggctgagtcgacaagggaagatgtagttgcggtggaaagtgggtctatttggaccaggttttggtgggaaggatgagtgaagctcagcgattctttttgtatacttggattcaaaatcggaccgttactcggcaagttacgtatcctattgtcgacaacgaccgacgttggaaataaccgagccgtaggcgtttgaaagcggctggaacgggaaaaccaagagaggagaaacaaagaggatggaaaagacgcaatcagctccgggctgagtcagaccccatcacggccgaaatctccccctccacggccagttgacgtcatgtcaatggcctacccatactcgtaccctggtacatgttttgtcctccacacggctcgatcagcccaaggctatgcacttttgacgcacgtctaaacttatttgagaaccctaactaaaggtgagttattagtggtaattggaaccctatctaagacacttgacgacaagtcaaccacctctcactaccgtctcctatatatataccatgacggagccctcggaaacgccctccacctcgccaatcgacacagacacagacacaaagacaactatggccaccgtcgcagtacctctcgcttctctcaacaacgcttccaagaaacacaagatggccaccaacaccctcattatcaccgggctttcacgagcgcacttttcgtccgagccgttcatgctcgagctcaaaaaggcgctagagtccgacgatctggtgtgctgggctcccctcaagtcgctgggccgaatcgtctgcgtttttgtgaccccagactcgtgttcggtggcgaagaagtacatcaagcaggcggccgaggcagcatacgtggacgaggagttcctcaactactccaccttgaaggcccagtacgcccccaataatacagacatggccactctcggcgacacaaagcagcgattgcaactgcccgacgctggcaagctcttcttcatctcgccccctccctctcctccggctggatggacctccagactcgaagatacccccaaccccaacgcctttgactcgcagttctacgacatgctgcacaaggaactaagcaacgtggctgagcccaaggaggaaaagaacgaccccatcaacattcctgtgagcgcaggtacccgaaaaatcactctccacgagggcctcaaattggacaccaaccagggcgtttccagcggcatgaactcgccaacaatcatcctcgagtgcgaggagggtgacgtcgtgtcgccgggagtcgcctttgcaaagaccgagagaccccctgtcgagctgtagacttgacgttacattccgtgcatagccacaacgcaacacaacatcctacattccgtggcaacaatcatcctggtatctgtggtcacaatagaagaacacgatacatactaatcatttattaatacactttttatttaacgcttttgtgggtactggcccgaccgtagtggccgtgcgactctgcgatacaacacttcaacacgtgcctccacagtgatgggaagaagccctgccagttctggtagatgtattgcacttgaaagggttgtaatggttgtcatgttcatgaagacgctcttcattctcaatagtcaccatagtcacccgtcttcatagtcccccagctagcatgaatcaacgctcgtcaacaatctcgtccactatcttgcgtgtcggaggccgcaactgccgaggaggctttgtagatagctggtacatggcgtgtttcagagtcttgtattgagaagaagaacatcttgaaagccccttgcttggggtgtattcgaaatagtctgacgacagagaacacgagaggttgaacagtgcaaatgtcagtcgtcgaaacactctgtcggagagatatgtccacctcgtgtatctggccaaggtatcgattttggtggggatagtggagctgtcgcaacccacatcttcaggtatttctccgcaagtttctgcggtcagaactcctccatcaagtgtgattataactgtggtattgtcagcaagagacactgtcaacgagtctccatagtgagtcccttcaaccatggaagtgatgtgaggaaaggagagcgacatgggtgcatgctgtgcttggcattgcaggaggacatcaagttttcaagagaggttgaataaatatcaaaatgatcgcgagattgaggaggttggtgcactgacacctggttatctataccagtgactcgaggtgaattataggaaatgagacgaatgataagaaatctcaaaatagaatgtgtcagtagtcgaaatgtaggagtgcgttatagtcatgattactgtacccgtacagatggcgttttgttctgggtctctgagatgggatgacaatgttggaatgttctcagctaaacagttattccttagcaagtagaatttattgtcgatctcgacctatatacaatatgagtactagcgtgctagtagtaactaatggttaaaagttaacagtgctgtctaagcagcggcttgggcctcgacctccttggcgatctggagctgggacgcaagctcctgctcactggcttcggcggtggcaacgggagacaaaacaccgtcgtcgttgtacttggctcggaagaaggtgtaatgcagaacaatgtcggaaatgcctctgaggttagggtcggtggcgtagtctgggtcgatgaagaagaaaacaggcatgtccacctcctcaccggctagcagctgctgctcctcgaagcagaagcactggatcttgttgaagtactgcgatgcaatggccggcgtcacggtgtatgtggccattccgataatgtccttgtcggttcggttcttggccttgtagaagcacaaggcggtttctccgggaataacagacacctctcgctgctggggtcggaagtcccagggcagaatgccggagacatcgcccgagaacgtgattcggatatgtcggccctgctcgatgggcttgagtcgctcggcggcaaatctggggttttcatagtcgccggtcttcatatttcctccgggagtgatctgtcctccccagcccatctgctgacacacaattcggtagacgggcacggccaggtatgagagacccaggaaggcaatgaccaccgacaggccgtagagaatcgtggagttgacatcctgctgacgtcgctgttttcgggccttggaaaacagctctcggtactcctcctcggaaacgcccaacctcttcatgttggcgtctcgtttccgcagaaactcgtctcgcgccgcctcatatggcttgcggttgttgaacactgctctggaggtgctcaagaggcgtgtctgtgtctgcgtcaacgaggtctttgcgagcgaagaaaccagtcgggcagttaaaagagacgaccggagtcgtgtggctcggggtagagactgtagcatggtcgtgagagtcgtttctgactaatttgctcgttttcgaacgggatcgtgaagactcgaaaatgtggctgttcagcagttaagtcaaaaagatggctttcactacaacttttcgagtattaaggttcgctgcctgtggctaattaaagttgcgtggaaaacagtaatcgggagtcttgccgagatgatagggaagatattgaaaaataagtaatgtaaatctatttgtcgtcaaattctcagcagaatgataccaaaaaatcgaatacactcctccaaaaatgcccctttcaagcccgcctcactccacatacattgcgcccaattaagtaaccctaatccacccaagccacatggatgtggctggagatcagctcattctctagggcctggcatcgaccacttgactgaacatatacatcccggccagaatacatgtctggagaaggcggagaaggcggagataggtgcctgcagtcacgtgacaatgcgtgcaccctttcagtctgtttggtaacgtgacttgccaattccaatccggctcgtatcattggtccatacatcaccccacaagcttagacacttccgatccagtctccgcttccgtctttttttgttttgtcttcgtctcgaaaggtcacgtgattgttcgaacagcaatggaacaggggcagggttagggcgcattcgttctgctcgtttctcgaagttggcgggtcttgcggctaactcgatgagtatgtagagtatgcgtcaaccgttgagatttggtcaacttttgcgatgttggtggatttggaaaaaaaaaacaaaaaaaacaaaaaaaaacaaaaaaagagaatatggtgacaaatttcttcacgtgacaagctcaatgatggtattattttctttgtagctgctcttcagcgtcttttggaaacgtctataacctggtctatcaaccttatccgtgttatggagcaatagtcttagaattactgtaccatctctttttgctgtatcgtgcaagtacagtatcacgtacaggggcaaagacattgaacagatgccacaaaagcgtatatgtttttccagccgaaaaggcggcgttctacccctcttatccaagtcgatctgtgcgtattgagaggtattgaacttcttttctcccaattttccgatgcacatgactcccagtttgttcggaaaaactcttgcagcagcatcgcgggtggaaggaagtgtgaaaggcgcgatgagcagactaggagcgttttctagagacttgagaaagcgaaatctgccatttcaacgactgaaagtacagtcaggcttttcctttggaaatgtagctggtctggaggaccagatagcgaatgctgtacagcactggtgtgaaagccgagcggcaccggttcaggcacttaattttagagtgaaatgaacgagtgtacgcaggggtgggcttggagggtatttttgtgtggcactcggtctgttttgtcacgtaatatggggtaactggatgtgtgtatttgattcaagatatctctgtcgctctatgtcatctccttcatgcccaaatagcatccgtggagagactgctaggctcaaagtcccgttggagactagagtctaaactgtgactaatttcaagacagaaataaaaggtgcttctagcttgtctcagagacactaaaagggacattatattatatgactcaactcgcattgatcggtaaaactcgctggtattttcggtttttcattcccacaatcgtagcccgcaatatacccctcctcatctccctctcatctccctccgttaaagttcagagggttacccattctatgctaccgaatctcaaattgtgatgtggacacccttaggcacaccacaaaagccacgtaaaaggcaccctcctggaatactataagtacacgcaatccaccctcttcttccccgcttcttttgcacctcctctacgtccgtcagcctccctctctctctgacgtgtgtcagaaatccccacatgtaactcaaatttcaaaatcaaaattgaaccaaaaatcactaccaccaaaaccaaaaccaaaactacttttctccaccaccagagtgacgacgccatattggaaacaaccggcactcgcgcaaagatacgacggatcacgtgatatatacacctcacgtgacacaagcgatacaccgcacgtgactctcaacacacatccacgcgactctgtcccaaacacacgaccttcacgacagagagtctagaccgacagcgataccccacttcaccagcacgacagtaccccagcagtaagacgacaacaccggtcacgtggcgtacttctttccattcacgtgacaatacccctttcacgtgactatacaacaacaccgcagcacgtgttccacagccagttagtcaacacaccaacgacatcctacaccatggacaacgagtacaagccgctccgaccgagcattttggcggctccgggacagtcgaccatgtacgacatgagctcgcagggctttgcggcgttcaacatgggctccagtatgttgacgggtcctcagaactacatgtatgggaaccaccagccacaacagcagcccatcaagcgaaccaagcggaaaaaggtcgaccaggcttgtgtttactgtcgacgaagtcacatgacgtgtgacaacaaccgcccgtgttcgagatgtgtgaaacgaaacatttctcacctgtgtcatgatgaagccaagccagtacgagggaagcgacaacagagccagtctgacgatgaggaggaagttcagggccaacagcaacaacaacagcagcagcagggccaaggacaacagggccaaggacaagtcagtggcttgaatacccccaacgcaggcatgtctgctcagttcatgaacgctggaggtattcagaatggtttgtttttctccgagcatgccggatccgaattttcctcgcttaacgactttctgaccatgttcgacgatgtagtttatgagggacagccgagtcagggtcagaaccagggccagcagcagggtcagggtcaaagccaaggacagagtgaaaacgggaccgggacccaatatcgccaaggacagggtatgcaccagacacaatctcagaaccattcccagacccagtcacagacgcaaacccaggcacaggccatgtctcagggtcagcgccaacaaccgggccatcagcatcagcagttgcagagtcctggtatggcacatccagctgttacccagcagcagcaacaaggccagagccaagcccaagctcaatcgcaaaatctctctaacgcatcccttacacacgaagaccctccccaggtttcggaagctgctaggaacaagttctttttgactgcggccgatcccactattgacaattcgcccgaggagcgtctcaaacaggtcatttacgccaaactcgaagcggggcttcttcagccgttcaactatgtcaagggatacgcccgtctgcagcagtacatggacaactacatgaacatttcgtccaaacaacgaattctaaagccgttgtccatctttcggccagcttttcgagccattgcacagtcgttgaaggatatcgatctggttcttgttgaggaggcctttgagcgaatgttactcgactacgatcgagttttcacaaccatggccattccagcgtgtctgtggagacgtacaggtgagatttaccgaggcaacaaggagtttgccggcctagtgggtgttcctgtggaagatcttcgaaacggcaagctggccatctacgagctcatgagtgaggattcggcggtcaactactgggaaaagtacggcaacattgcgttcgattcgggacaaaaggccgtcctgacaagttgcaacctgcggtctaaggacgggcgaaagagaaagctatgttgtttctcgtttacaattcgacgtgatcggtacaatatccctagctgtatcgtgggtaatttcattccgattaacccataagcagactgagcggactgcagttcagagagagaggcatgatgagactaccatgttaaacgtctcgatgtcgaaggcttgccattggcctccagcttctacactgtatatatatatatataagagaagatgtttttattatcattgtaggtcaacatttggtggagaatcattcgtccaatggtctcgaaggagaacttatctgctcctctttcgtcctcaacatcaagtcctgcgtggaactggctagataaagaatatgtcaggtgcttggaagatctgacaaatattcttccacagacccaaccccccagaccaactcttgtcaacctggcaaaaagcttggccgctgggtcctggaatcttggatagtggatcaaaagttacaatgcatgtcaatactgacacactagttccgtgttgctattggatacaatgacatccgttaagacaccaggctgcgtcactattgtgctgacattgctgcgattctatcaaccaaaccgttacgacattgtactgtgtacacatcttcgtaaacaagatattataccattatgtagctctttttgagcaccatctatatattgtggagctgtgcctttttccttactccgtcttagccttcttggctccaccgtcctggtcgcttcgctttcgctttcgctcctgcaaggccttgtcggctcgtctgttgtgttcgagaatgtcctccacgtcaaccacctcggcaagagcagcatccagagcagacagcttgtgtccttccacgacaaccttctcctcatcctcttcaccagcaccgatcttcagtcccttgggcatgacgaatcggccgtccgactgctgaccaatctcctcctcctcctcctcgtcgttctcgttgaacacatcgtcctgagtgtacaggttgtcagccaagtagatgggcaatgcgggagacgatccggtcttgaggtagacggatcgcacgccatcaaagccgttgggcagatcggcagtgaactggtcaaccacggcgtaaacgttggcggcaatctccttgggtgtaaacagagttgtggccactcgcacgtttgtgtggttggactggctcttgaggtaccaggtggaggtcatgatgttggagaggccctgctgggtggcctcgacatcaatgtcttcagtctcgaccactctctcggccttggacttgatcagagtctgtttttcctccttcttgtgcagcacggtgatgggcagaggcagcttgacggctccattcttgtaaaaggtcttgcccaggcagaaaggcatctcctcggtgatgtcctcgtcaaccacaaagatgtcgtgtgcagcaaacagctgtcgtcgggcctcgtagggcttgaacttgcctcgcagcttctgtgttccaaccactcgtgacagagcgggggtggtggcgcccttgagagctcgcttgtacgagttctgagggttctgggacagcaggcagatggagggctgctctgcactcttggtccacagaccgtgggggacctggaccaaggtggggacctgggccttctcggaagacacaaaccgcttggaggtgatgaccaggtagataaactgctcctcgttgtcgtcggcaagcaggttgttggcgtcctcttcggcctgcttttgggtgaacttcagcagggcctgggcagcgttgattgtgttgtcggaggatgcgagagggcacgacgaggtctcggcggtggacacggaggatcgtcgtttagtgggagtggcttttgagggagtatcgcccttggtaggggtgtcaacagcagccttggctgacttggtgctcttaggagtgcccttaggagtgcccttaggagtacccttgggggttcccttgggggttcccttggcagcggatttgggagtggctaccttggacttgacgggagtgcccttgggggttcccttggatgcggatttggcgaccattgttgggttgtgtagtctggtgtctgggtgtggatcgcaggcaaaataattttggcataatcctaaaaaaatttaagagctgcagattttcaaactcaaactggcgggtggatttgagcagagccaattgaggtattatcaaagattttgactgggattatagcatttgtgagatcattaattcgcatatatacttgttctaaataaaacccactttttcgcttgtcgatccgacacctattggtctagatatggtggtcctgttctcactactccctgtcgtctatagttcaactgaacgttactctgactgaagtccgactaccattgggagggcatatcgagtagaggaatgtgtcgaatgtgtcgaatgttacgaatgtgccgacagtgtctgggtggcgttctgtgtgtgtattgtggcggtgtttgtcttttaatgggacggtgtgatctatttggaggtaaaattttgaagaactcacttaataaacgtttaagtatagttgactctacttgaccagttcagttgactataactttgtcccaagtaaacgtcaactatgactaagtgaggaaatctacatgtcaacaatctacaaactgtacagtacaacggatttttttatctaaaactctgctgactaaattaaacggtcgtttcggatcacctgatatctcacattactctccagctaccttcattcaccgtcttgatcacctcctggtcgattgcgattgccctcaacgttgcaccacgtgactttgagtttcgatacaatatcgcagaatccaagctctgcagagcgtctctatcatacacacaaaaaaacacatcatggtgagtacgagtgctggagagaaacatatggtttggacaaacgactgattagtttgagagcaactacagaatgtggtatcatcggcaatagagggacttcagacatcactctacgcgatgacatacatgagacgcattacaagggtggttcgagacatgacacgaacgaggatgtacttccggctggttcggttcgaccatcccataggagtgtcttcctatgaagtcgattcgatactatcggcttctcatcagcgactgtagtgaagcacgacgacatggcctcaccgagaggttgaccctgaggccccattgaaccgtgttggtatttatcgtggtgctcatctgacttttccgttcgggttatccacagccgctgaaatatctgggcgccgcttcaagcaggcacgagatggtggtctggtcacggttttttggttttgctacattgttcgattcgccgctcaacatgcttctttcatcaggtcgaatctaacgtctggtatgattcatgaacagatgtgccgcgaccactccacctactctcgctcgtttttgacatctgctaacacagggaaaacgaaagtcttcctctgcccccgccaagaaggtgaaacaaacgctggcaacccagtttgcatgcctgttttgcaaccacaacgactcggttgtgtgttcaatggacaagaaaatgggcattggcagcctatcgtgcaaggtgtgtggccagtcgttccaggccagcatcaacgctctgtctgcgcctatcgatgtctactccgagtggatcgacgcctgtgaggctgttgcggagcaggagaagaacaaggatgacgagttcattgagaaggacggaggctatgctagtgacgacgaccacgtgcccaaggaggaggacgatgagttttccgatcttgagtaaggcggaactcacagggcgaacaaacagtgcatgtataagaaaagaatgtatattaaatgtggatggggtggaaggggggcatgctgacttgctgtaggaatggaagggtacccaaagaaagggcatgagccgcagtgtctaatactcgtacaattggacgaggacttcttatggcatcactagtatctacagtacagtatgtacgggtacgagtacgtacccatacattgtgcagctgtcaaatacagtactcattttttgtacaaagtccgaataattgctccggaacttgtctgacaactcttgtcgggccattttctctcggtgctttctttttccattagagcatgtttactcatccagtacacgatccctgatatgacagtcatgatagggttgcgatgttattgagagcggctcgagtttcgggatgtccaatgctacagtcattagaatactgtacttgtagggatatgaacggagtatatatgtgatctattcagcttgtgacgtgacagctacgatacagcagaatggtccggctctacaccaactctccacaagcatgtccctcaacaggtgcgccgctcactatcgtacttgtagggaaaccaaacaagcggtgtcttgtatatgcgatcaattagctattttagtgcgtttattcagcaagcttggggaaaaggtcctccttgagggtgatgccgagctcctctcgaacgtccttgagagcgtcaaggtatgcctggtactgggacttgttgtcaaccttgtatttaagaccctcgaacactcggacggcggtggggaagtcgttgactcgtcggcaggcctggagagccttctcgatcacggaaggtgcggggaccagatcgtaggcgaaacagttgttgagaactcgctggacctcaaacagatcgtaagcctcctcgaactccttctcgaatctgtgttagtaagatgaatttaactggccagcagctcattggtgacgtgtgaacgagtcttggtcgtaccacttggtgttctgtcatgtccgtttatggtgagtgctgtgatgagctgtgaggtgtcattgtacgttgtagttcgaatgataggtcaatcatcaagggtcagatgtctcggataaagacgacaaaaccgtcatcttgtcttcattccacctcccaattccctgcgtttgtgattgtgtctccctgagccgattcctgtatctcgtcccagctgacgcctgatagccgaacagcaaacacgacaccacagcaaacaccgtcatcacgtgttcactgtaccacacgtatgactagccgtttcccacgtccacactcgtccatctcgtcgtttcattaaccgcatcctccatgtggttgtactcaccgagtggtgaactcatcgaaagtctcctcgtgagcagcgctgtagtttcggatagcaagaggctgggctcgcacggcctggaaggtaggtcgggcaatgctcagtcgagcagcggagttgagggcggagcctcgggcgatagatcggaaagcagaagcaaagaccattgtgatgttggggtagtgacgtgctgatgagagtgtaaatatcaccgtttcgaaagtggtctggttttccaaaatgcaaagtcaaccaaacttttcggcaagctgattggaggagtccaccacaacattaaggtttcgacatgtgcagtacatttggtcatggcccaatacctgggaatgggccataggggacgagtctttagtaatcgccgggcgggggatgatggggctcgtttgagctccgtgacacagaaacaaggtggacacagaaccccgcacaactttgagagcaacttctgccgtccaacctccatctccacttccacccgctcctagggggcgcttccacaacattctcagcccgccttgccgacagtatgcgggcttgggacaaactggccaatcagccgtcagctatgcacggtcagctgtggctggtgtggctggtggcctgtttttcgagccaggtcatttcgagggttgtaagctgacaagagcgtgtcagagtgtctggagagtaagagtgcacttttagacgatgcgcgattgagcagatatatcggtgcattatttgctcatgcttagtcattggtagtgagtgaatgagaaaacatattgacaaggacttggcaaatatatatgatgaatgggtctacttgtacaagtagaccgatcagagcagcacggtgcaagccgatttcatctcatttgatcttttattctttttctttttctttttcttttctgtttttatctctttttcgtattctttttcgtattcttttcgttttctttttattttccaaaaaatttcagattcaatcctccgcagtcacgtgacccgacattcatagtttgcatgcagacattattctggtgaaaaatcaagggccaatacgcggaggaggtcaaaacacgctgagcgaatcagtactgccccgagccacgttcaaactgctgcttcacgcgcactcacttctcgtttgccgtttcaccgtgaaaaaacgcctcgtcgacagcagatcaaagtgtttatatgacatgagacggatcaacgtggccgttcgtaccgtgggtctggggccccggtatgactacaaagcgttggttccatcgatacagatgccgcgggtgtccattcgggtgcccagaagggcattcagtgcgcttcaggcgcctcagggagggctgcagttcattcaggacattctcttggccgaagagccgacttttttgcatttggttcaggaagtgattgagcaaccgatacgggagggaaagaagggccccaagggcgcggtacacaagctgcagatgcaaaagctgcgtgttttggcgcggattaaacacatgaatctggggttggaggaacaggtgagaatggtggcggcaaaccgactcatagatcattccagcctgctgcagttctgggaaacgtgttcaatggacgatggaggagatccgcagcttccgctctctacagctattttgctgggtcagcagatggtggccgatggagaattcgagctggtggccgactttctagccaaccagttctcgttcggagacattcttatgctgggcggccgggtcattgccgacggagggcctaaaaataaacagaaacaagtggtgacggcgttcgaactgtgcagggcttttgataagcacgggtttgcccaacagctggcccgggagttttggataggtaacatcaacggaggattgcatttttgtctggggttggatagctgtgcaacggagcagcagcttcaagactttctgtaccacaacgaccggatcaactaccggttgtccaagtacaatagtggcgcgttcatattggaagatgctcttaagccatatgagaagatgaggctgttggaaaagtacgtgcaattgggtaacacggaggttttgcgcaacttgtttttcaaccaggctgctgaaaaacatcaggaatggatccatgcatgcattgagagggtgatacgaatggctatcactgactccagacttttgggggtggtcaaggacgttttggagaagaagaatgacctcccagtgtggtgtactgctcgagtaacggctctagtgaccgatcagaagtctctacgaagtctctgggcaagatatactgcacaatatgcccatttggctgaagatgagactgtcaaacagacaatggtgacgtttctggagaaggcagtggccctgggagatattcattcggccagtagcatcaccaaggtgcttggagagaacactccgattcccttagttaaacagtacctgcatctgttgtttaacaaccgtctacacaagcgtgagtcagacaagtttgatctgattacacgtctgttggatgcatattcgagccacccttcggtaatcatgaaggctgtgggcgctgtctggcctcacaaacgatatcacaagtcggaggtgcttctatgggacctgctacgtgccttcgaggctagtaagctgccccattggtctcagcttctggagaagcattttgctctggcgatttttactcggcctcctgttgaaaaagttgagtactacttcctacccaaagtgtctgtgcgagccatctggctgtgtattcagactgagctatccaaggccatggaggctgtgacgggcgatgtggatcgaagcggacgtctgcagttgatcactattgctctcatggctatcagaatcaagtccagaaggaggcggttccaaagaggccatttcttggaagctgaaaaggaggagtcggaggtagagagcgatgatcagccagagaccaggttagtcgtttccaacccctacgctgacctcgatttgagcctactgcctccacgggctcagctagaacggcttcagatcccaagtgagtacctgaagattcgagatctggacatgttcttactacagcacattggcaaacaagagaagccattttcacagcttgtggacatggaccagtggatctacgacgttctcagtgtggaaacatacaaacccaacttggagacgctgtctgttgaagaccccgctctggcctacagactcatccgatggttcagacacgacttcatgttccccattccgcctcgaatcttgcgggccatggtgcccgggtttgccacttcagaacagctcaccaacagcatgtctttccggtacatttccgaggttatctctcagctacgtctgcagcacgagcgggtgggtcctgaggtgtgtgaggagctcgtggactcgttgtttgatcgagttgctcttcctggagcgtcgcgtgacaagaaacggcttcagtgggctctgacgctcgccaagcaggagcaggtggacgagcaggtggtggagcgatggaacaagcgtttggaggatatgaagaagcgtcaggacggattctggaaggaggcatgaggaaaggggtttgtttctccacgctacacaacagtattggtaggccaatgccactcattccgccaaaactggcaggttgtccggtatacaataatagggcgtgtcccgttgcatatatataattataatgaataacgaatgcatttgatctgacgaccgcgagtattgtacaagtatcgcgcattcgctcttgttctcgtctgacatttaccataagtatcgcggtcattgctcggcgtttgttttcggctactgctcctgtccaatttaacaacgtttgttttgccaacccccctttacttggcaaaaaaaaaaaaaaaaaaaaaaaaaaaaaaaaaatgattgggttgaggacgatggggtggcagcgctacttgtaggtgaaagaccgccatttacgagacagaaggccctcggaagaggacctggaggaccctgctgtctgtcgaggacagtcttggtctcttccacgacccttctttacatggtctgttctttgttgtcttgttccatgcaatttgccgtcacccacactccttcgagatcgacgcactgtagtctcggaagcataatatgtcaacagagatggagatgacactcgcggttgggtgtggactgtgtgtactgtaatatgtgactgtgcaattgcctaatcgacgttggtcgcactgaccgacacagattgacgattccatactacagcaaacctcctttgcgctacacacttgctcaatctgtctgcgtaggcgcctcttccgcgttagcttgctctaatgcgggcagtggcggtatttaatcgtgcgagatgacattaaaagtggttctagcttgtggacacatgtccagaggcttagctgggcttagacgggcttagacgggcttagacggggctgagaagtaattagacaacgtccaagcccgtcataattggtaatgaaaccggcaacagacggactgcgaccgactgcgaccgactgcgaccgactgcgaccgacttcgaccgactacgatggactgccacaacagaccgcgacggactgccacgacggggtgcttgcctgggtctgagtataggacgaccctcaactgttcaacaggcccgttgcgcatacagtgacgctcgggggctcctccgtgcaaacatgaccaccagtgtcaaagttctggtctagtggacaaggctgatgctgatcaacgtcgacaaatgtctcagaaggataatattgccggacggaggctggaaccaggagtagtgccgaccgggtgtggtctgagaagaccgtccaccggactttgaggcctttttccaccgctgtttgctaccgctgtttgcgctgttgttccctccgatcgccctatccacgcaaaccaaatagtaataatcacagtctattgttctaattataaatacactaccatacacaccagtcagttgtactactgtacagtacactatgaacaagtagcgatgacaatgacaaatgagcagagcagcaaaactgcaacgagaaaagctggataaaacggccgcggcacctgcagggcctggttgccatccgactaattaacgacccggcagatctatcggtggatctatgaggcgcttagcacacacatgataactaactatgccctggtagaggcacaggcaaacccaaatggcggagcaaggaagaccatgtgcagggtgtatacattgtgtggagtggatgtcggggcactgcgggagggcgttggatggctgggttctgtcggatgggacacggaccgcctgttcctgttacactggttctgttgtggtcccggagcagcgcgtggaatctataaatacccctttaacccctcgtctgctcaactccctccccctatagtataaggtgcgcttgagggaaaaagacaagtgcaagcatgcacagcaactgcacagccgctggtcactcaaatggtgcaaactatacgccttttgcaaaagtatatgggtggagccttggtagcaattgaaggaccggttctccagacggatttcgatcacaagacacgacgcgtgcccctacgaccgccaacacaaaccagcaactgctactctgacgatactgaagtcatctcaccttgataggcgcacagattataaacacaggtaaaaccagacaaaacacacgaccatcgctgctgctgtcacatctcaaaagctcaaaagctcaaaagttcaaaacctacagccgcacattccagatacactctcgagggaccactgctaggtagatatttacccactcttcctccacaccacacccagacatgcacttttccaactttctgctgggcgctctggccgccactgcggccgccaaaaacacgtaccaaatcaacaagtacgggtcgccactgaccaaccagaaacgatcgctgagcgaaaactcggtcgtccagctcgacacggttggcgtgcgatccatccgagatgagcctgctccccgagacgccgcgctcatgaagcgacagaccgccactcttccgctcaaaaatctcgtcacatactacgaggccgaggtgaaaatcggcactcccgcccagacggtcaagctgctgatcgacaccggttcgtcggatatttgggtcattggaagcggcaatcccgattgtggctccgcccaggacgcccagcgagaccccaacatcatcgactgctccatctcgggcacctttgatacctccaagtcgtcatcgtggtcccagaaccagacggacttcttcattcagtacggagaccagaccgccgccgagggaggctggggcacagacacctttgcattcggcaacaccaacgtgtctggcctatccatcgctgtggcctccaagaccaactcatccaacggagtcatgggtatcggtctcgctggtctcgagtccaccatcacctaccgaggtaacgaccagatctctggtaacccctacgaaaacctgcccatgaagatgaaggccgagggtctcatcaaggccaatgcatactctctgtggctcaacaacctgtcttccgacagcggcaacgtgctgtttggtggcgtcgactacgccaagattgacggagacctcttcaccgtcaagcttgtgaacccccagcgatccgtgtcctccaagcccattgcattctacgttggcctggactctgtctccatcaccgacgtcaagggcgtctctggcttcatcaccaagcagcccgttcctgctcttcttgactcaggaaccaccctgacctacctgccccaggacgccttcaactacgttgttcgggccatgggagccacctacgacccccagaacggatacgtgtgcccctgtaagaacggttactccggacacctcgactacaacttctccggcgccaacatctctgtccctctctaccagctcacttaccccatccagctgcagtcccagtctggacgagtggtcaacgcacagttccgaaacggagacgacgcttgtctgctgcttatgcaggcttcccaggaccatgtcattctcggagattcgttcttgcgagccgcctacgtggtctacaacctggactcgtacgaggtgtccatgggccagactaagtacggagtaaccgacaccaacattgtcgagattgacagcaacggagttaagaacgccaatcccgcccctgagtactcttcttccttcactaacgtcaactccgagaccaccattctgcgaggagctcccggctctgctgactccaacccttccaccacactttctggcggtcttgttgccggctccagtgcttcttctggctcttctggtgacggtaagggcaagaacaatgctgctggtcttgagctcagtatcgttggactggccgtcgcagttgtcatggccagctttggtcttatgtaaacgcagcatgataagccaagcgagtctttgcaagcaagtctttccaagcaagtctttgcaaaagcaccttgtctggcgaacccactcactgcggcatgttcatcacgttcctggcatgtccactatgtatttagtatgataatagaatttataaatgggaggataatgagagtagcatgagggactgagccttaagcttgtgagcgtcaagaaccagtacattggcagtgcgcagtgctttccatgagtttcatcacttcattgagagactcaatattgtatgtacgagtacgacctgtacgagtcatgtagggtcgcaggggtgcttcggtatgaatagcagagtcaaaggttgcgagcaagtgtttcagctgcacagcaggtggactaaggggttgtttcagggtcctatcttgatgttggaccacctatggattttgatgtgagatgagctgggtggagagcagttagtcagaaaatgtagttgttcagagcacgtggtcagagagaacatgtacagtatacttggaggacgtccatggccacttttgtcggtgatatgtagccccttttcagtgaggtaattggtttgggggagcagccaaatacgaaacacgagttcaaacatggtccgaggttccacacttgatagtacggtgagacctggagagcattccgattggggctaaatcgccagaacaaacgtgcaactgtgagagctttggtcacgcgagctacgggcgactgaacgggctaatggttggcagttgacgaatgatgatgtatttggtgtctttaatgaagattgcatcgctttgcaggaacgcgttgaggtcgaagtatcttcacacaacagtatgtacactacaagtagcggcgcagtgtgtacagcttgtaccaaaggtatagggcagccgaaacttcaagctgagattcaaaggtgggtgagacgttgaagtatctcgattattgctggaaagtgaaaccaatttttttcgcagttgtacaagaaacagtccttttcttcaaaggatatcgttaaactaaatgtcaactaatatgaacgaatttgcggtgttagttaagagtaggtcaggaagtaacggatcgcaaaaagaggtattgctcagctacagtatacagtaataaaatgtacgttatagtaagctggcataaaaccatttgttgaatggtacgcaatgtgtgctccataattctatggaattgcccctaagcttggcctatgtcacctccgtatgcccactgcactgtcagatggttacagtagcaagattaagagtgtggatcaagtacgagtacgagtactagtacaagtattgtggccggtgcgatatgtatgagctctacatgtgtcagtgtccatgtcctctgggaatgaacgttttgtggatactgtacaagtacgccatatagacaacctactcaggttatacaagaaaggaagggacactgagaactccaccgaggagttgatttggaggcatgacgagacggtaaacccgatcaagacttggcgtaaatgacgtgctccacggatatcaaataattgccgacagatatctggattctccccccccccccctccccaaattacctgtcaggtacacttcatcgcccttccgcatgcgtcatgtaagataatgcaaagagaccaacagagcaggtgggggccccgccccgtgtcggtcctagacctcaggtctcatagaaagaagttatagcaattgggatgtagaaagagagtggtgaggaatttaatcaaaagcaatttgctgtatgtgcgacagacaatggattttagtgcggaaaatgaaatttcaccaactttctcctatcaattaggcagctttcaggctacttgtaggcccatgacgacaatcagtgctaattttggacgccatgactgcccttgtgcaaagcctacagtaagagtacaagtacaccgccactcaacaggatagacatgatttctataacgctgccccacctttctgagacaggggtgtcgacaccggagatggcgagacaagaagagagccatatagggaatatgccgttgattggactggttatttgtacacagttgcaaaacatgcacccgatgactctacacatgtctcaccatgtgaagcagattgtttagagagggtaagaaaggggttgtgagtaatatcgctgccaactaccccaccacgacgctgagacacaaggaacaagcaccagtacttgtaggtggagtgggtatgtttacgtcataatcgcacccgtatatgaattgccatcaaagagagggacaaagccgtctctcccaccatgaccaagccgcctctcccaccatggccaagccgcttctcctctttctccagggcgacaagggtcgacgtctaagacgtggttgccattgccgccagtcttgtgcatccttctgtgggattccgcgtcgggtcttgccttgggcggtataggagaagcacacgtgcacgacacggtctcttgtatagctcgctcgccggacgtggggttggggcaaagacgggttttcccatggccaatcatagcagataaactagacacgcagggaggtgcatgtggtgagcacgggagacacatttggggggaaactaggtttgtcaatccaggttaatttgcagcgctgcaggcctatcagagacaagtgtgggggcaggtggtgtatgggccaggctgtgtggtctttttgtggttattttatgtggattgggggtcctcggaaccaagtgccattgagctgtttatgctgagtgtatttttgtcggctcctttttcaaggccaccatctttaatacaccccgaccgctcattccacaagcttatattgggcacacaagtagctccagactccaagagacacgtttttggactgcgttttttgaatttcagcatgcaaaggggcaatcatggtggtactgtggacggcaagggcgactgccgaattgcgccggggcaaatctcagtttagatgatcatttgatttcctggaaaaacatgtttgtgctggggagctcagagtagtgtaccgccgtatacggtctcatcggccgtacatacaggaggcgctgcacccagctacgtgtgtaacttgagtagcgctacacagggtgaaggcgggaccgaccaccaccaccctcccgacccccgacatgggcccacgcctcctcgagacccaaaagaggaacagccaggccgaccaaacgtgcgcttgtgtaaatggagtttgacagtcaatccgtaccgtctttgagtttgctccacaaggttgatatcagcattgtccatgcagcggcgtggtttgggggacatgtgtccaaactcagctgtaattggttcctgggcggttgggtaggcttctcattcaacgtggatcatgtctttagagcgtgacgtgtcggtcgtgtgagccgagcggtgtgaaatttcgcgttagagggggccccaccagctcgaatcgaacgccgaaaacacagccctcaatggctgcccacacccctcctcctcgcacccagaccaccatcaccacctctctcacttgccagagaccccttctccaccccacccaactcaatcgcctgctcgcatgacagtagagtttgccctcgtgctaacagtgacgctttcaacaggcaccccgaaagccaactaacttttataaatacccgtagcccccggcgtgctgaggtctcgtgtagtcgtttccgttcactttaccatttcaacatgctacaatacgccatccccgcctttcttgttctcggactggccctagtcttcgtcaactcgtcggccaagaccctggccatctttgcctggaactgcttcatcaagcccttcaccggccacaaggacgtggcggccggccagcagggcgccctggagtccttctacaagggccaggccaacatttacgaccgaacccgagccactctgctcaagggccgagagcaggctctggccaccaccgccgccgagcttcgaaagaagcatgatctcgtgtgggtcgacattggaggaggaaccggctggaacattgagcacatgaccaccaactaccttcccatttcctgcttcaaggccatctacctggttgatctgagtccttctctgtgcgaggtggcccgaaagcgattcgccgagaagaactggaagaacgtgcacgttctgtgcatcgacgctgccgatttcactccccccgctggatcctccgttgatctcttcaccatgtcctactctctgtctatgatccccacctactatgccgttatcgatcgactctccaccctgcttggcaaggacggtctggtcactgtcatcgacttttacgtccaatcccatgccaccttgaccgccaagtctactaccatgggcggcgagctgctccggcatgtcaactggttctcccgaactttctggcgactgtggttcgagtttgaccgggtctacctcgactctgcccgacgagactatctcgagtaccgattcggaaccatcaagtcagtcaactgccgaaacacccgactcggaggaatcccctactactactggattggatgtgacaaggaccgatccaccaacattctccagcgagccaacgctcttgctaccgagtctccctacctgtccccccagaacgagcttgttgttggagacgaggacgccgctaacaacactctggctatccgatccaagggctacgatgccgctctcgtcaacatgcagcgaaacttccccgctccctcattcttctaccagaccgaaatctggcgaatcttctacaaccaggagctgcccaagtaccaccagtttgccaaccagtacatctacgccttcacctgggaggacccccgagaggacaagaacattctacagtttaagcccagcgataccgttcttgccatcacctctgccggtgacaacattctgtcttacgcctccatggacgctccccccaagcgaatccattgtgtcgacctcaacccttgccagaaccatctgctcgagctcaagctggcctgtctgcgagtgcttccctttgaggacatgtggaagctgtttggtgaaggcaagcaccccaagttccaagagctgctgaccaccaagctggccccccacctgtcttcccacgccttccagtactggcacaagcgaggccacgcctctttcaccggaaagggtctgtttgataccggctcttcccgatgggccattcgacttgcccattgggtctttgcaatttctggtgtctccccccacattagcgctctgtgcgaggccaagactctcgacgaacagtggagcgtctgggagaagtcccttcgaccctgtctgtccaaccccattgtcgccaaggtgcttgttggcaaccccattttcctgtggaaggctctcggtgttcccgttgagcagacctctatgatcgagggcggtatgctcaagtttgtcatcgacaccttcgagcccatcatcaagcgatcgctcatttcggacgacaactacttctactacctgtgtctcaagggctgctacgctgccaacaactgtcccgacttcctgaccaagcacggccacgccaacctggccaagcgaaagggagctcttgacggaatccgaatccacaccgacgagatcaacgaggtggtcaagcgactcaaccccggatcagtcaaccacgccatcgttatggaccacatggactggttccccaaggacggtaacgccgctcgagaggagatcaagtctctgcaccatgctcttaccgaaggtggaaacgttatgttgcgatcagcctcccagaagccctggtacctcagcgtctatgaggaggagggcttcaccactagacccgctgccatccgagaatctggcacttccattgaccgagtcaacatgtacgcttccacttgggtctgtaccaagaagggagccatggagagcctcaagatttagactatttattatagatgatgtattatatgacaactcatggtcaacctgggacgtacttgtacaagtactcgtgcgagtacatgatgtaacattccacaacaccaaatgtgacgctatggaccaaacaaaaccagatatcaaaaaatgacacgtgtaatagtgataatagtgacatggactcgagaaaaacgcgctcctacgaaatgagagggccgaaggagataaagtttggtttatgtaacaaaatcctacgagactgtatatggggtgatatgttccccctttgatttccattcatcttagctgtgctcatatcttagaaaaaactactaaatgatactcatcaaaatcatgggagtgttataataccgattttggaggtaatatcttgatacgagcctcttctgccgggacactggcatcgacgcaatcagaaggcacaggcgatgataacagaggggctatcatccaacggtttcattgtcgaataaataaccgctgtggctttgttgtggggtatccaactgttgagtaatgtgcctcgatgaggggaatatctttgttcgaagtcgttagtcgcacagcccatggccatttgaagaagatacgaatgacaccattcgaaagcttgaatctggaccagtaagatacaagtacttgcagttcaattgctggcagtgttggagaacttgttcctgcttgtagtttcaatgtctgttcgaccactcagttatcagcgttcctaaccatagcaaatagtcgtactgcgctgattggagctgcaacaatgttacatctatggcagttctgagatgaaagagtttcataagagcaaactttggatttctcgaatgtgttcctgagaacaaggccaatgtttgctttacccagcggttgtgcaaaccagccctcgtgcctccaaaagcaacgaaagtagacccaatgagacacactagtgtatggtggctgtttctgtggcgtagtcagtcgactttgaaactgcctcacgcgagagatactgtagctgcgatcatggactcattttcacattgacaacgctcagggtccccaataaggacacaggtagattgggtagcttcaatcacgtctctctagaacaagcacttgttatctcgttggcgtccttttctttgtactcttgtcgatttgattctccgaggccaatttgtttttcgggtggcccaatcctcttgctcgtccgacggtttctgcagcacctgcctgctggtcgaacactgtgggtccagttgccgaactttcagcacccaggtaaaaaagcgtactttacagtcttgctggcgagttacttagttcttaaagcagtctaagatggggcggtgacttgagaagaccgactttaggaccgacactttacttctacctcgggattctctctgtgcctgtatcttttctcgcttaggtcccggcatctgacacatctccacttggctgcgttatcttgcatatagcgagtacgacagacagatcacatcttgcatcgagtgccgtacgccccacttgggacgactcaaaggtgtccaaaatgagccattacagttaatcattttaggactcatactttgagacagccctcgcatttttctcgctgatatacttttagccgtattttacatgaaactgggaacctctaggggagagtgtacaagagaggtaataaaggggtgcaagagatggtgaaagtgaccccgcatcgcgccaagccgtcagaatggacaccatccgatttttctggcctgccaatcccttcttgccaagctcattagtcaccagttgacagacttccctcaggaacagacgaaactctttctctgacaagacatgggccgtatgataagccacaattgcgcagcgataatgaactgggggttgtcgttgttgtagagcggctatttgaaagccctttcgacatgtctctaattctctccccctcatcgatatcaacacatcttccccactgttggttgttttgcgttcttgtgatgaaagggctttttcaactgtggccaggtcggccttctattgttaacacgcctcggcccatcacgatacagacgactctcgcattcaacatagcctaatgctaattccacgtctaactgagcctccagataacaccattggctggcagcgttttcatcttactccaggtcccctatcagagttccttcggcctcgaaccttgagtcaagataagtgaaatgaacatgttccagctcaccggggggttatgtaatgtgagggagtataagtactgcgagcgataatacagtgatcgagtagaaaaatactatcaatgagcgagcgaaaatcctttacggaaaacgtcgagtccgacaactctgtgggcgagatccacgaggtcaaggccgagggaccccccgacacttctcacctcagctactggggtcgattcaagcacggttttggtccggcagatgtggcacacctcgatcttgagggtctgacacccatggagatcactgctctcaagactgccaatgcacctcttcaacgaaacctcaagggtcgacatttgcaaatgattgcaattggaggatccattggtacgggtctgtttgttggatctggaagtactcttgccaacggaggtcctgccgcccttctcattgcttatggagtcattggtatcatgttgctgctgaccatgcatgctcttggagagctggctgtctgtttccctgtctctggaggtttctgcacttacttcactcgatttcttgatcccggatggggctttgccatgtcctggaactacattatgggctggtttgtcattcttcctctagaactggtggcagcgtccatgacagttaacttctggaacgaaatgaacggtactcacatcaatgcagcggcctgggtgtccatcttctggatcatcatctgcgccatcaacctgtttggagtcaagggatacggagaagccgagtttgtcttttccatcatcaaggttgctgccattgtcggtttcattctgtttggaatcgtcatggctgccggaggaggacccaagggaggagccttccacgagtaccagggaggtaaactgtggcagcatccgggagcctttgcccatggtttcaagggtgtgtgttccgtctttgtcactgccgcctttgcctttgctggtaccgagctgtgtggtcttgctgctgccgagaccgagaacccccgagtcatgctgcccaaggccaccaagcaggttttctggcgaatctgtctcttctatctcgtttccctgaccatcgttggcctgctcgtgccctggaacaacgaccagctgctcaacggatcctcttctgccgacgcagctgcctctcccttcgttattgccatccgagtggctggtgttaagggtctgccttcggtcatgaacgtggtcatcatgatttcggttctctccgtcggtaacgctgccgtctacggtttctctcgaactattgctgccatgggagagtccggacaggcccccaagatcttcgcctacattgaccgagaaggtcgacctatcttcggcatcctggtcgttctggcgtttggtctgttctctttcattgctgcagccggtgctgaaacccgaaacgaagtcttcaactggctgctggctctgtctggtttgtcttccgtcttcatctggggctccatctgtgctgcccatattcgattccgaatggctctcaagtaccgaggccgaggaaccgacgagttgtcatttgtggctggttttggagtctggggatctgtcattggtgtagttctcaactgcctggtcctcatggcccagttctggatcgctctctaccccctgggagtcaagactcccaatgcctctgacttcttccaggcctacctggctgctcctgtcattctcggattctggatcttctggaaaatctggaaacgagatggcctgttcttgcttctgaaggacttggacattgacactggaagacgagagcccgatctcgagagagtcaaggccgagatggctgaggagagatacgccctcagccagaagaacttcatgtacagactttacaacttttggtgttagacaaaaaacacaactccatccccattctatatactcatataatgttgacctttggtgtctgctagttatttaatgattgattgctatactactgtacacgagactgtgtgttatgtacgagtaccactacacgagcagcgctttagaatggcggccaaatgaaacttgtttcgagaagccacaaaatggtctaatcgattcaattaattacctcatccaatgggagggggtcgtcatgttgccacagtatgaccattccatgatactgctgatgctgaaactacagggctggcttgtaggcagatcaaaaatcgacttttgcccccagataagtcatgcgttaataattctgataaattttacaaatctcggagatttctttttccaactgctaatacatagacacctttcgacaccaacatttcgtcttttcgtttccttatctaccttgacctgatcgaccctcttatctccagaaggtgatactctaatcttgagtgtagcattgactttgcatcaccttatttttgtacgtccggaagaccgaaagaagtggactcttagggcgctatttgagaattgaagagctggttttgttgccgtagtattaaattggtctgtttcagtctaattccgcaatttcggacccctccggtctctgcccggctacttctctgccgtatgtactgtactgtacaagtacttgtaatgctggtctgaaagtcctccccccttgcgctggtatgaaacgaaaaaggatgttcaacgccaaatccttcccatccggtttcattatcggcagctcttagccaattgattgtggttatgagactgtattcgaacgtactactgtagtacagaaatgacttaaaacagaagccactccatggtctacttagttagttgcacgacggggaatgtcagacatgtctgtgtcaccgccatcagttgggccgccgtttaccactccattggaatcctcccctctcgatccagatccctctacctgatacatctctttgggcaactcgtggtcctcaaaatgttcaaactgaaaagttgcaaccaaggtagtctcatccaacgaaaagggaggccgtcctttgtagatacgccgatacaccttctggcgctcgtcatacgcatcagggatccgaaccgcgtcgtgtgtgcctctggagctatcctcgaacttgtgtggctcgtcagagacgtcctcagaatgaatcacacgcgtaaaaacaggatcccctccacgaacagtttggggaatgcatgcctcatcccaccatctaataatgttgtctccatctgacgagccgttcgatatcttcttaatcaccttcttggagacccagttatccacagagaagaatcccacggaagacccatcgccagcagcaaaaggaatagataaaacctgtttggggttgaaataggtcgttccagtcttcagatctccaaccaccagtcccttcgcgtctcccactgtcacgaattgaccctttctctgtattctggctccttggaactcggcttctccttcgttgaacgtgccaatggctgggaatcttctgtcccacaccgttagaacctgtcctcggaaaccctttgagtaaacatgactcatcaaccctccagtaggatgctgtcttgatctcagaccaagatcaacccataagcgcagaaacctgccctcaaagtaaaggtataggtagccattgtaaaatgtgaagaaaggaaagctcagatggttatgcattctcttgaatcccatccccatgggtagctcgcacaatacgacccccgggagactcgggagtggctctatgtacgccaggtactgtgcagttttaccaccttcagtgttggagacgaccaaggcacccccaggccctggcacaagactgacaagagttccaagaggattattaacagcgttgttgtcgggaagtggccatgcatttccatccttggccgaaacaatgcaagcccctgattggtccctaggatgtgatgtcttgtggacgattgcgtctgctccgccaatctgagaccagtaccgaacatgcagcaatgagtcgttctcatccaccacacgaatcttgtatccttcgtggtcgtttacaactctcagtcctgatggagacatggccatatcggttcgcctgtacgtgtattgtagccggtgtgtgcctgggaagtcgcttttggacacctccatggtcttgaaatccagctcttcgcccggaagcagtagtttcgtgccctggatggctcctccttcgtaaacatcaattggaaggaggtagagctcgtcgaagatgggctcaatggtttctctgacctccttgtcttttgaaaagtccacagaatccacaaattccaccttgttgcaacataatgagaccggcactgagaggtttcggagcacgtagagatgcttgttggcatttcccccggttccatcctcctccaatgccctgtaggaacgtctcgtcaacagcaaggcacatttccgccatgagtcaagcccacattccgtatccaaggcgatgaaccacggagctcgctccaccactctctcacgaatcagagactcgtccaactcggtccataccgaccaatacgaactgcatacctgactgagtgccacacagccttcgaggttgcagtactcgaaaatcaggcgtatgagttcgttgctgagcatgctactaagttataatgatgtatgtgtgtgcataatagatgaaggcgttgaggataggaaaaacagacactatcgtaaacgccacagaaagcggagttatggccataaataaatacaagaaccattgttggactcttcatagcagctccaataattctataacatatattacacatacatttctacccgcttgaatacccagcttccaccgatatactcgagcttcccttctaaccttgcatgaacctacaaggtgtgtgataccatatcatcatcgtcatatcatcatcttcatctccatctccatctccatctctcaaacacactagagctcatctctcaccttgctgctggcccccatgggcatgactataacgtacttaatgtacaagtcgccatgcgagtcatcgacgcccatctggggcatgccgtggttcttgatcacctcaatgtggccatgctgggtaggctcgcccttcttacgtgacagaaccacctcagactcctcatccaagaacggtatctttcgggtccagcctccatgaagcgcctccttgagcgatagagcctctgttcggaacagatcgttgcgccgtcgtcggtagcccatgttctccgttggtgcctctctcacctgcacaatgagatctccagccacgtgatctggcgacttgtcagcttcctcttcaaaggagtagctgtggactcgtggggttccgggctcaatgtacacgttgtactttcggtcctcccgctgcaccttttgtcctccgcacttgttacaagggttggagatgagatggcccttgccctggcacttgggacactgctgctggaacttttggatcatcatacccatctgggccacctggatcaccactccgcttccgtcgcaaccatcacacttgtggttcacgccgtcagcacttccagagcccttacagctggaacagattccctgcagattgacctggagatccatgtcgaagcccttgaacatgcgcttcatagacacgtcaatatgggtttctgtgttggggcccttgggcacgcctcgtcgctggcctcctcctccgcctccaaagaattgtgcaaacaagtcaaaggggttggttcctcctcctccgccgttcttgagaccctcgtggccaaacttgtcgtatttgccccgtttttcttcgtctgacagcacctcgtatgcctctccaatctcgataaaggtctggtgggcctcctcgtttccggggttcttgtcggggtggtacttcttactgagggttcggtaggccttttttatatccttgtctgacgcgccctttttgaggcccagaacggcgtagaagtccgcctgcgcagccaccagccacatcagcgtcgctagaagaaatacggcctgaattgccagtcgcattgtgtcgttaggtaatggatctctggaacgctaccgtcttctgcacgagccacggtgtacgttaatcccatcacgtgagatgggggtttattcgtgttaaggttgtggtttggtgaaaaagatggagaagacgggtacaacttgacagcacgaggtgtcccagtacgagtgcaagtacttgagattacaagtgcggcacgctctatatatgtactttttggatgtcacattttcgtctttagaaactgggtgcttttgccgctcatatggattggacagaacttaagacaggggcttggttagtccctggtagatagtaggtctatggacgacattccaaccagggtagcagagttgcactaagtcgtttttactacagaatgtgaagggcgtatgagagacatgaatgactactacttgttgtaggtcatattgattgccagctgtatcctcttagacgatcacgagcacctgattcggtttgagatactcaagatgagatgtgagaccgatgatccatgagtactgataatcatgggtgatgtatgtaagtaatagggaatactcatgcaataacctaggtgccgatatgggggtttcaagaggtcaattgacagtataatgagttttctgttggtcatttttgtacgttacaggtatcttatagtcgttttatgtgctctataagcggatatcatggaggatctttgtttaaccacaatacttactttagttggaatgtgaagagcttatggaagaacttttagttgaagattcacttacaaacgaggacttcatacctattcaaaagcttaccaaatctgttgaaattgaaaagtcatatttaatgcccccatattggccgtccacactgctatctttcacgtagcgtcaggaacacgccttttatactgacccctgctccaacaccctccaatataaagttccaatcacagtgcagaaggcggaacaaaatatcagtctccgattcacaaccattcaaccatgagagaaatcatcacgctgtcgtttggccagaccgccggccatatcaacgccgactacttcaattcgcaggagcactactttcctctcgccaccaaatcgacctcagaccctactgtgcggtttcgacgaggagtggctaccgacagcagaactgagacttacaacccccgtctgttgacgtgggagctcaaaggtgggtatggagctttccaggcattcaaccaattctatacagagggcgacaagagccagccgcaggtgtggaacgaaggagagatcaaggagatcaaggagcagcctgtggacaagaacgagtaccaaaaggcacttgatctgggcagggaaaacgcctcccagctcaatacagataccaccaagcgatggaccgactacaatcgactgttccatcaccccaaaacccgccaccagctcgacaactggctgtttgaccctgacactgctccccaaggtatccatagaggaggcgatcaaaagtggacgggctttgacgtgggtgtcaacgaatgggaacatgtgctcaattctgataaggagtatctcgactcgactctgcggtcatgggttgaagaatgcgactcgttgggaggccttaacgtcgtggtagacgactcagcctgggcaggagtggctgccaagatcctggcaaactacagagacgactttgacgccaagggaacggtggtcacatggtctgtggaggccaagcccgaaaagaagacccgagagacacagaagaatgccattcaaaccactgtggctctgtcgcaggtttcgtccatctacattcccgtgtctttccctacaaaaacacccattgatgctgatttcgaccctaccagtccctggcatcaggcagctctctttggcttgtcagtttatgagcctgttcagcttatggccacccagagaaccggaggcttgtcgttggacgctatggctgctttgctggacaccactggggagagaaacattgtttccgaggtaggaggcactctcactgatgttgatggcgacaaatcaaccgttcagtatgactccaggctgttccaggagctcttcttgccctccagaatccccccaaagaccccccatgtcttttctgatctcagcattgcccgattggaggatcaggatgacgatgccaacagctaccggttgaaccaacccatgcccgaggtttcttctcagcccgaattcactaaacagtttgtcagctccaagacccgtctggccgtaaccaccaagccccgacgaactcttctggacatggccaagtttgtgtctgtgtacgaacgaggagacgagcgtgaggagatgaagcaggagctcggcgacatggcttccaagtacgagcatggatgggaagaggaaagtgatgacgatgatgactactaagtaatgaaatagctgtatataatacaagcagtcacatccatgtatttgatagaaagggaaggtgtattggttagggatccacgatctattaaatggttaatctagttatagcatattatagccacttcatcatggaaacatgtgctacttctcttcagttgtctcctttgcttccaagtctttcttgaactgcgcgatatcagaaatgccagtagccgagcctccacagagaacaacaacaacgttagaatcaggtttcaaatcaaccagatcctttagagcaggcagaacagcgagggaagctccacaggcgggttccacgatgatctgcttggtctcagcgtactccaccagagctgatactgcgtcgtcatctgaaacgactgcagacacagtagggtatgtctgggcgttttcaaacgtcttgtcagcgactcgaacggctcccagagaagtggcaattgacgtaattccaggtagagtgacctgctcgcccttctgtagactccggctcagagcatcagcaccgtttgtttccactacaatcacggggcagttgagcttgtgtcgtttaaggccctcgactactccgttgaacagtcctccgcctcccacgctgcacacgacggcgtctggggtgattccctgcttgatgatttcgtcgatgagagtcgagtttcccttccacaccgctggagcgtcaaagggatggcagtagattggcgtttttcccgtcttttcgagccgcggcatctcttccttttgcagaaagtcgttggcttctgaccagtgttttccgtgcacaatcacttctgctcctgcagctctcagtttctccaccattcgaggtttagtcgattccggcacaaccaccgtgcacgcgacaccattgagtcgcgaggtgactgctgcggcgagccctgcgttgcctccagagctggaacacacgtggagagtgtctagagaagcctgggggtctgagtccagcgcatcggagatgacctgggtcatgcctcgggatttgaacgaccctgagggctgcaagttctccattttcaggtacacgttgcacccgacctggtgcgagaagatgtcgttcttcagcagcggtgtttcaatgtagcctggtcgcattgtgttgtgaacaagtgcaagtagacgttgcggataagatcagactttcatagatatgcactactcaagtggtacttgtagtatgtaagaccattggaatacggattgcctcgatggatgatacctgagagatttacatggggtttgaagagtagttacacaaaaagataatgctgaatcgatgggaacttggtcgctcggtactgtaccccttttttcgttgtcaatagacctactttgcgtcagccataatgattgatctactggtctggtctgcatactcacacccccaaatgcataccaagatatcgctagacgcacattgtatacaagtcatgtgctggctgagcgctataaaagggtgatacataccaaccgtcttacatgtctctgtatgagtagttgtacttgcaactggttacaaacacttgtacggtatactggtatgtacagtatgtacatacttgatggtaccttggtaattcagctctattggttatccaataattaaatatattaagaatctactacaatcgatgaccgggaacacatgcaaaaataacggtgaaacaggcggtgacaattacgacccagagcatgacccaggaggaccggatcagcaacagtcgtcgcacaaacggctccttgattcgaacccgtttggtcagactggactcggaaaagcccagcactgcctggatggggtccagagaaaaaagcccggcaatcaccagataccatccaatggcaaacggcaagagcacccagacccgctctgttcgcgagtaattgagaaagatgagacaaaagccggtccacacggcgccaaacaccgccactagaccagccaccattctcaccagcgctcccagaggcaccaggttgcctagtgctttggtggcaaggaagccggggaacacctctcgttcgagaatctggaaaacgtattctcgacactcgtcaaacacctcggggtcgtctcgtccctgctgttcgatggcggtccggactgactccatgagaggtgcgggcagggccagttcacgttctgctccaggcatgaaatatgtgacgaggatctgctgtgacgactctcggatccgttctcgggtgatgaaattgggcgagttgacgtcgctcatgacgccgtgctcgtttctcttggggaagagcttctcgatgatttcgagggtcagaggctgcgacgacgctcgtgagtccacgccaatggggccacggggctgcggcagcgtctggggcaacgcattgagttgtgtttgtagcggagatgcaggttgggtgcccagaagaggcgagttagcgttgggcgattgcggcaggatctgcgacagttgcgagtttctgcgggtcgccagattgggacctgtgggctgcggttgttgtggcagcgcagactggggctgtggcgtttgtggttgctgttgtggttgctcgccagagttgtctggagaagggaactgcagctgggattggagagtcggaccaatctgcgactgcgacacgttggacatggacaggttggtctgctcctcgtcgtacagctgctgcagcgacggttgtgcctgggcagccaggcccagtgatgcacgtgacgacttgcggttcagtgagaggcgtgaagagccctgcagtgagtgggtcatggatgctcgagaccccggacggaccatgccgtgttcttcgcccgcgtcctcctcgtcaatcgggcttgcggcggcactctggaacaggttggaagatgcattggacaggtgtgatgcccgtttttcctcgaggttcatcatgaaccgctcgcttcggttactgggcgcatggtcgtcgctgatttgcgactcccgaacatgcatggcgcccagcagggcactgagacgcgaggctgcggacgagtcatggtcgctcagcaggttttcgccccgcaggtactcggacagacgatgcgagtcgccgtcctccagcagattgtggtcgtggataagtgtctccagtaggatggatgattcacgagattgctcggcaaggccctgcccggtgatgttgctgatgctgaggtttgtgtgttcgctggcgaggattgactggcgcagaccgcggatgtagtggcggcacagcgacaggtgctggacgacatccagccaaaagtccaggtagtccacgcctcggtgctggtcccgcgtgtagacgtagaacgaccacaggtcgactggcgcgagcgattttcggttgagcacctcgaacagcgtcggcagccgtttgcgctcgtcctgcgggagtcgagtgaggctcattgtggagatgtgtgtcttgggtcgtgtcttctcctggaaatcgcgttatgacggtcagatgttggctcggtctttggtcgtgcggtgttgagcagtggtgggaatgtgtgtccgtgtttggaccggtgatgtcgatgacgacttgtagtgctgtaccactctgctcgcacacctgttgttggtggtccgtgacgttttttcaactggtgtcacacgttggtcgggtgaaatgctggctggtgagttgtaactttatttttacgagactggaaataaaaagagcttaagcaaagtaaaaatagggggcaggatgagacaccggggcggaagagtgagacagtggtgagagcgagagagacgagagttggtatggaagagacgctagtgtccatttatttgtcgccgaacgctcatatttgcgctgccagcctctttagagctacacgtccaaacagtgtccagtacagtgtacctgtgaatgacattcgcaagtaggataaatacagcgcccaactctcttgtttactttagtcccaaagcagattgacgtcatgttactggaggagacggagataattatgcgagtaacggagggaaaaatgagcatctgaggcggctctaaagttgctacggggaccatgttgtgatatgtcatttaacggctcctttttgcctctctatcccgtttcgtggtccatacaagtaccaccccaatatccaacacctgacgcggctgggaccccagaactcaaacctgcataccaccacactaatagactccggaatgtgcgcctgacgaaaagcgtgtttggccatagacgagaggtccatgaaacatgtctgcagatggcggtttcggccatgtatcaggaggagagaccacaagaggctccagaatcgaagccgtggtcattgcggcggttgcgctccagatctgtgaccattgtagtcctggcagtacggtacttgtaatggttgcatgtactcgtactcgtagggcccactacactgtatgctattttcgtcacacctatttatggatctgccgaggacgagaaacgaacgaccaacgacgaacgaacgaaaaattgacaaacgaaaaatggacaagcgaaaagtggatatgggctgcttatataagccggaatcccacacaattcccttataggacttggataaacacggccatttaatatctggtgcccgaagtgggtcatatggggctgggactacagtatcaaggggctggtgataatatttttagacgtcgacattttgagtgtggaggtttgaacggagatctgtttgaagaagttgtagtgtacaagtacatagtgtacaagtagagacagcagttgttcacgtcaagagatgttgaaagattacatttgtacaatgtgtgtgattcaggagattgaggagtctttggcctctttatggtgctcctacttgtaactatactggaactcctgaagcccactctgagttatgcatcgtttgactcttctggtgtgcgatactacagcacaggtaggtacaaggggaagagttgttgttattatatgggaaccaggctggcgatcgggttattatttgctggttttgtggcatactgtagtttcaaggcttggtggactgggtggttgcggaggtatcgttagacaatctacaatatgtagtgtagttaagttagttgatatcttgagggatttgtcataacgagtgcagtagttgtaagtagtacgcaagtaaggcggctagaattaacaggaaagttgttataatcggtttttccaattatcctcgactataactaatctctttcacttattatcttacagtagtatccaccttctcacctacatcgtcaaaatacataacgccagtgcttgtataatcaatgatggtgaaacggtacctcattctaaacggctcgtgtttttcataatttcgagattttaaacatacaattcaaatccttaccgtgttgttatttgtatcttcaacttcaattttctataataccgatattaccccttttgaatctcttctccaccccttctggccccccacccccctcctccaaaaagctgcttactaacaactctattttatgcatgccttttccacactccagggtcgcacgatcctggccatgagcacctcagcatcatcacactatcgctagcaaccgcacacagaacgacatcgaacagcatctcacacaaacacaacccctctgcatcatcatacacataaacatccatccgtccccctcaccacattcacaataccgtcgatatcgatgcccaactactaccttgctgacgacacaaagtacacccgtccttcgacgtcggccatgtccaatctcacagagttgtgtgggctcaagggcctggcggactcgatggcgcggttcgaccccgtgaccggcgaaaaaaacaagctgcgaaagtcgtacaaaaaccaactgctagatctcacgggcaagtttgacattccgtcccagccatcactggttcgaatcatccgagaccccgttctggcagagaccggaggcaagtcgctgtctgtgttcgatcgagatttgctgtcacgtggtctggactttgacgccactcccagcacgggcattcccggattcaacccggccatgctgggtatgcctggtcctgggaagcccggaattggtccccaggtcggaggcaacagactactgtcggtgcgaaggagctacaacacggagtcagcaagggagagtagtaacaacgaagagaccccgatggcgagacgcaagcgaaagggagacgatgataccgacggagagagacggcgcaagagaaagtgagattagtacagttgagggcgtattgtggggtctactgagacctcgccatgtggctgaggctgtacaaacgtgctgatagtgcgacagttcggggtgcctgttactggtacctctggctgagtagaagcggcgaaggtggttaagcactgtaaaagagccaaccaagtgtgaccacactgggagctgaatggcatgaaggcacactacagttggagttacaccgtcagctggtcgatgtactcttcatcgaaccactcttctacgattatttatatacacagtgttcctactgtttctagaatacattttgttcataggtgtatgaaggcaagccagatgtacaagtcggccctgcatgaatggaaggccgggagaagtcataaggaagagatacttgcagttggacgaggttgtaggcgatgtatacttttagttggatctataggtaaccagcgggtacagtagatgtgatgtttatgaagtgggaactatatatagatgcagtcttgtataatagatgcgatccctattgactttatcatgatatacagtagttacatagtcgtattgtagatgactgtatggacttgtagcaaacaaacagatctaagttgtagagctacttgtgacagttactatactgagaccatctgtcatcctaaggattcgtttggaagctgtttccaactgaaaaattcttggtttaatccctcgtatagctcagttctccatctcactagtatacgagagattggccgacggtatcgtactcattgaccagtgtaacagtggatgtaacctggataatgcctcggtctgagacccggtctaacaaatgcttctaaccgtacttgtcgcaactactcggtgtcttttcggggaagacagactacgagtctgtgcagacagacctacatcacagttgtttccattggccggattttaacggagcggctatggcaacgttgtgggtctcttgtgccgtctttgctgcttcagcgacggtgttcctgccgagcacgacgatcgcggtcttcctgtgacgtcaccaagtcggtttcacggtggctctagtttttcgctttgctctctttcctccgctggaggttgagttccggtcggctccgggtcggctcgaataggtactggtaggactgtgtagacagacttagtttgggcttacttttggcaacggttctcgcttaaacaacgcggcttgcacttggcctagctataccaaggagcaactcgtatagggggggctcggaaatggacatgttctgtacatgcgacggtgttgcccgcttgttgagacgacccccatcccagcacttgtccgcaacagggcctgtgacgtcagttaagtccggtgagtaggtttttggaccgcgctaaatggccatctccgtttttcattgtcgcttctttttcacactttttttcacactttttttttttttttctcaacgccaatttacgtcattaagtctagacctccagttagccttcttggtcagcctggggaaaccatgccgcaccacacggacgtccgtgaccagcggtcatgggacacaagttacaaggtagtcgtttcagctaagcgtaaagactggcttgcaaacaatgccccggatgtgcacgtcatgagccgtgtctttctcaagtgacttggggatattttattatctggagctggcgcgaaccccaccccccttcatattagcttacaggcacgatattactcccgaaaattccctcatatctggtcggataaatatgaagagagagaaaggcactaaaccaaagacagtacatacttgtccaagcggccggcagctgtcaaggagctcccactaccctatttaatccggcgtgcctcgacgtgcttgcccgggccgtagtcactgtgctttttttgctcaagtttttccgaattctgcatggttcaacgggtttgggtcttgttggagccactgggcgtgcgctgtgcgctagtctggtgcccacagcgttatggggttagcacaccgttcaagtataagccatgtaattaggcgatattcttcggataaatggacaggcggataaacggataaaaacggataaaccaggcacatacaggcgcggcatgggcagcaccgcacaagatccacatccagccccacatgacaaacgccgaggcccattgcatacattccggattaatagtttaggctacagtctactgcagagtgcgaagaaaaaaaaaagtgtggatgccttttttgggttcacactgacgtaggtttgtcccagacccaactctgctagaggtctttgttagccgacgagaacagcataattaccggggaaaacaggatgggtccaaaacgggctggagaagaggtgaggaggtggaagcaacgggaaaatgttctgggggacgtaagcagttgattcgcgtttccggcgtgtccgtgcgccgtctcgtcaccattctggctctctccacctcggcccccaccagctggttccccaagcatcttccccaatccacgtgagctaaatcgcggagaaaaaaaagtctgaatccaaactgtgcattaactctaatgcaatgttgtgtgttgtggtcccgagactgggggtgtatatatcgtggaccttgccctcgattcggtctgcatcctttctcccccaccgcatccccattccccgtattttttggccctctgcgcacaaaaatacagcccccactcgcaacacaaagacgatttccgcacacattcacattctacacatccatcttccatcatgaccgacacatcctacgttaacaccatccacgagggaaacaacaaggcacgcgacctggtgaagaagcacaaggtgctggtggttggtgtctcttgggccgctggctttgccgagattgtcgccgacgccaagaaggcataccctgacacctttgtggtggagtttgacaagctggacaatgctcttgacaagctggagctgcaaaagtccttccgaaacatcacggaccactgcgtgacccccgacatttttgtcaatggcaaggacttgggcacctccgaggagattttcgagctgcagcgagccggaaagctctctgaaaccatcaagaaggccctggtctaagcggtccaagcgcacttgaccagaccattaagcatgaaaccaccccccaaaaaagaaacgcatgattcagagtgaatcatggacgattgacgacgagagattgtacattaccatctgtaatagacccatactgactgaataaatgatgattacccattagaaggcctatggccattgtacagtacaagtaatatacaagcaccggtactctggctcaacacccctcaggaacggcatttcgttcagcagactcacttcaacagactcacttccccaccaattaccccaacatattaccccattcttcagcactccatgtttcttgtttgacagcggccatttttctcttgactttgcgcccatatccaatcgatgactcttatctcatgctttgttgacgggtttgactttggttttcgtattgagggaaaatcgcaatgtgaaagaagcgaccgctacagaaacgggaaacgaaaaacgaaaagcacctccgtctgcagaaggacgtttagaagcagggagacatgtggcggtggcagataagacagaggggggagctcgatggaggctgcggacgagctgttacagttactcgtgattcggcccatcaaaatatattttttctcgaccccactctaattaccccgccacatccatctcagttaccatctctggggttgtctctggggtatctccaagcttagccttaagtacacaaacactgcgagttggtctcttttcgtccttcttcgttgtgctttctttttccactcaaattacccggctcacggacttatcggggatatgtgggtaccgctaaagtagcctaataaaaccttgtgagtaaccctgattcacattactgtgttaatgttcacgctacggaaggagccggaaaggacaggttatgagtgggttggttgtgtagtcagcaattcccacaaaagagcaaaagtcagacgtctgtcgtgattagcagcgctactttgctgtgcttggtcgtagtaccacaactttgctcctctgcagttttaactatacccatactgatatgcccactcgtagttgaaaaccacactatgtactgatcagaatttagttacacccatgccaccaaaactgccgggcttttactacgatgaagagcgcaaaaagtacttcaagatagtaaagacgggccaggcgacatctgcatcgcaggattactcgatttcggcggtggaaaacaccaaacggcaaaagaccagagaacggaaatttcacagaacggagcaacgacatgttcgaaaacccacagctcctaaaatcgacaagattgtgcttccaaaacactcggtccacgtgaccagtcgcgacacgttccatacccagctccagcggtatctgcattgtcgagaaatgggtactttacagcctggctttcagagccgtcttgagtctcgggctttgggatcgttgattcgggtcacagacgtggaacaggtgggccaggtgagtggacgagacgacgtgaccgccattgctttggacgaggagaatggagatgtatttactggcagagcctcggggatcgtcaatgctgttcgtcgaggcagctctttgattcgagagtcgtatatcagacgcattcccgacaatggcaccataggcacggttattggcatcaactacaatccacgcacccggttcctatggtctctatctcaaggtatgcattctgtgctttgtggagggatatctgaagacacttacaacgactccctgttctacgatttgcacagcatgaccaggctgcagctgtgggacgacaagtgtgtgttttcatgtgcacagagccccgaaggagatattcttctgggtctcaacagccagatacagacgtttacaggtactgctgggttgcatcgtctccatgccattgatatgaagagtgacgcaacttctgtgtgttatgagcaagagcaggtggtttttgccggctgccgagacggaaatctacgtcagattgatctccgtgaagatcgcaaaggcaagcgggtcaggagtccgtttcgaatctcctctcccgtgaccaatattggagcacagggcaattttgtggcttgtacgggtttgcaaggggttgtcactgtgtttgaccggcggatagagaagcagtctttatggacggcctcttacaagaacgactgtacgttccgacatggttttgctcttgatcctagtggacgtctgatgatggtggctaatgacgatcagacagtccagctgtttaatctggctggaggagaggagaactggggtggatctgccgccaaccttgtgagctcggtcaacggacaccggtttgctgacaatctggcctgcatccgatggactgaaggcggcgttgtggccggtggaggaactaatttatattttatgagcgaccgctcgtaagctaatgtacttattcgacaaggtcttaagtatgagagtgggctgggcggcagggtgactgtagagtgacttctgaagctacaaaacacagcagaaaccggatttagggtgggtgtgaccatggaccagagaactaaccagtagctactgtttgaaagacttgctggtgtctgtgcgccgctaccatagcgagtaagatgccgcttgtgaatgaaatggatcaacatcagttggatcatctccttctgaccgaatctcccgatatgatttcggctatcgggaaatttcatcccattctgaccacagtcagagtctaactaaacgcgcagggttagttgaactataatgagacaagtggagaaccaagtgagtgcatattcagcaatactgtatggacaagtctagagctgtctctcatggtatctttgacgaccccatcccgtctatataccggtgctatcgataatcccgccctccatattccaccaaccaccattttttcataccatcctaactagccagcccatctccatccgctgattggcccagtagctagccccaactacaggtagctacaggcaccgtatcgatacagcctaaggactggtcacactacaagtccagtatgagtgcagtacttgtatattgtacaaaacattcgtaacaaatctcctattaatatccccgacccctgaacagcgacgaatggcaagttccgtattgaccctgtttgaagctggtgataataaagctgtacagtcacgctgcatgaaaaaataaatcatacagcgtgccaagtgtaactcgtaccaatacggtaagcgaaagatgttcgtcggtaccaataccactgaaagtacagtcatgacagcctggtccattcgtgtgtgattatgtaatcggaaaccttattgtgcgggcctcagatcaacgtttgctgtggcatgtatttgctggattatacgagctggagcaaatagtgggggcgggtagagaggggaggggctatgacaagttacaaccaatctcctaggcaacatattgaagctaaagcgggtgcctcatcttggctgtgtctgtctaccctggatagacatgtcttggatcaacaagtgtgtgtgtgtgtgtgggccactctctggtctgttggttgttatgttgcaggagtggccaaagtttagccacagcctgtaaaatacactttgggcccaccccggtcacatcgggcgccacggtagccacgagcagcgcccggacgagcaaaaacgtcggagaaaaaagatagcgtgggcactggtccgtggctgctggaatctgccgcgaagagatgaacaagacaaattttggagtcagctggatatcttgcatgaggcatgcatctcctgttatcgcaacaccttattttagagtgcatgtgaataagcccgccaaccaacacaaagcggttgggataaattaggctccgtcaacgccaaggatttctgttgtcacggttacttattgcgaggacggcggtgagacgaaaatgatggccgagagatgtaagatgtggtaaacgggcggcgcacggtcgtgtgacggctcagtgtagctgttgtcggtgtgttgctgttgctgtttatgacgtcatctatccattgccttgttgtggacttgttgtacatgtgtggcggatcaagaatatggcctaaattgccgagattgccccaatcttgcgggccaaaaattgccccataaactgcagctggcgtggaaattgcgaaaattgcgcctcaggtccgttggctccctttccagccgcaggggtggatgaaatatgcagtttgtcactgaggttgcaaataggcttctttagcaagtgagacggggacggggcgacgacggggttgtggcggtagtttggcggatatgggggcatggttgtggtcgcgttggagcgctgattccggatctcttttcagaatcggaaaaacgccactattggccgccgtagaagtcccctcaacactgacctgtccatatacacctcccaatcagcccgcacaactctaacatgtcttgcgcttaatgaagaccccaattgacatccaccacgtatgtgtatgtttcactgtcgtctggcggagggtgtaagggcctctgaggcccgggtttgcggctgccgggtcgagaaaggacacgtgtagcccaggtagcccgtgttgcccgcgtgggtccccttcgttatgcccacggcgctccccagcccgctgtagtaacctctttgccctttgcccgtggtcctagactcagagaagctactgcacatccccgatccgaccctttgcagaactttgcatcttttggcaggttgggtttgagtaaccatccagagcgagactactgtagactgagagagactgcgagacagaaggagaaagagacccatgttccatagactgagtgtggggctatcgatggagaggttggagacccggagcgcgattggggcagccaaagaagaccgcgaaacaagccaacaagcgccccaggtctcctccctgacagcctgcggtagactccagcactctggtttgtgctgttccgcctcatgcgttatttgccaacagagtcgaggctagggctcaaatatattttaaacctaataccccctaatatccagagaggggaggaggtgaggtgacagtcgcgggctgattgcgaggatccgggctcggaaaacagcagagatcagctcgcccggtctccagcaccacaaccataccgcttttgcccttatccttcgcccgcatggcccaccgccaaccggtctttgctcgccgtgtgaggtgagggctgcagaccttgtgcttatttatatctaccgaatttaaacccacgggcttagctagaaacttgaccacatcttcttgtattgcctcattcaaaaccgacctcttgtagaccttcggaccacattgagggcctttatggtgagtatcacagcgacgacagagcccacacacagcactcctgccagcagcgaaaacagcccacaaaaccccccgccaggagccggttcacacccggtctctgtcactcaacaactgaacctggttgcgccacagctccagagccaccaagccggaaactgccatgaccgcgactccatacggactacacatagcccacacacacagccgggccctttccgcaccgccacgtgcccctgatggaccagctgcggtggttgtcttggacgtcctgtgctgcaccagtcttcaatttcaagcggttcacacctcggccttggtttttggtagttaatggttggagctagctacagggttacagacattgattgatcaagagcaaattgcgggatgatgtgttgacgttgcgtttacgtggcgaccacagagcgtctgtgacgagcccgacccacggcgacatccgatccacacttgcgtttttagttgccccgtgttacacttaccaccacccacaaggtccagttctttcacctacagtttcactactttgacccaagagaaagatgatccccttgtgtgtgtgtgtaagctcctactgcactcccaacaccttactaacgttagactttttgccatccctaatcgcggggtaaaacacattgcctaattcggaataatcttatttgccacttttgatccagacctcctaccaaaacccccttcacatgcacgcctcctctctatccgtggggtctatttcgaccgccgaggagcctcacacccccaagcaggcttggaacctgcccggctacgccacccacgactcccgcttcatgctgggaggctacgacgacctggtgggtgacgtgtcgcggctaaatcttgctccctcccaaaacggaaacatgcccatgtcccaaaacggaaagatgaacatgtctcaaaacggacatcctaacctccccgtcagccacaaccacagccagcatcaccgtacccactcgggagcaggcggatcgcccattttcggcaagtctgtctttgtggaaaacgaagacaaattccctattcttgtccggcgtccctcctctgccgtttccccgcccttggaagagaccttccagcagcagcaccacaatcatcatggcaatcacggcagctacaatggcaacggatctccacccatgcaccagcccctgactcctccttacgagaaggccggtggcaagttcaattgttcgaccgctgcaaacaacaacaactcccactctgtcatgcaggccattcctgcctctccgctaacccccaatttgcatactaatctgtctcctacgtttgtgggcagcaacaaccactaccgacgagcgtcccagcccgctagcagttgcattcctccggcattcacccctgagcgaagccccaacggcactgcgtcgtctggagtacagaccccctccaccacctcgtccaagatctcctccattgatctcaacaactgcgacatttttgcgctgtgcaaggaccagcacgggtgccggtacttgcagcgcaagctcgaggaggagccgtactacctgaatctgatttttgagcagacccacagccatgtggtagagctcatgacagatccctttggcaattacctgtgccaaaagttgctggaaaactgctctgtggcacagaccaccgtgctgatccgaacggctgctccctcccttgtccaggtggcgctcaaccagcacggcactcgagcgctacagaagatgattgactacgtcaccaacgacgagcaaattgaaatcattgtgcaggccctcgagcgaaacgtggtacggctcatccaggacctcaacggtaaccacgtgatccaaaagtgtctgaaccggctcaactcgtgcgataccaacttcatctaccgagccgtgtcgcagaatctggtggtagtcgctacacacagacacggctgctgcgtgctgcagcggtgcgttgactacgcggacgtattgcaacgagaaatgctcattggtgttatcacaaaacacgctctgcagctcgtgtgcgacccgttcggcaactacgtgactcagtacgtgctaggcgagcaggtgatccgccagtttgtcggccacgttgtcgcgctgtcgatgcaaaagttttcgtccaacgtgattgaaaagtcgctcaaggtggcgtcctacgagcttcgagcggttctgattgccgagatctgcgcctcgcccctgttgcctaagctgctgagcgactgctatggcaactacgtggtccagaccgccttggacaccgccaaccagtacacccgggcacagctcattgatcgtatccggcccgtgctgcccatgatccgtcagaccccttacggacgacgcatccaggccaaggtcgacgcccgagtattttattattagtgtattataagtgtaagatatatgtatattagcagtggcctgtaggtgaaggttttccgtcgtagctataagtatagagactatgtttacagagacgaagctcagggccagtacttatactagtgtatctacagcgtgacaccctctgagtgacggttccgacactgtagcagatggctgaagatacagcgacgctgtagaacgccgggaaaatgtctcaagaaaattaatcgagaaagttgtcatattgcttcagccgtgtgaagccgtgggtggaggctgtacatgcagtagagagtgatcattagacaatcgaaaagtgcccagttttcggacaacgaaaaaaaaacaacagcgtagttctgtcaccctaatatattctctccagtctaatgagcttccgtaccctcgggcgtttgcttgacaatgctacaggtagctggctatctgcagatcggtctcgctgtttggctcttgcctatttgggacccgcagggctcgcatcctgcatagtgagatgagcagcttcttgtggggtgtacagcgggcgtgtaggtgatttggggatggaaaacgaagtggaaatggaacatgtattccgtagttgacaaagccattctatttggaccatttttgcttctgaaaagagatattattatgtttccccagagtcggttagtttacggaacctgcgttagcggcgttttaaggttcacttatggccgaatcgagacatgggaaaacacacgagtcgagggccatggacaatgtataagagacagccaaagaagcagtttcatctcgtctaacaaactactgctgaatcgctgatacatcattgagagtgagtacgatgagtcgagtttctcaggaggcaacaaaccaaactaacacagtgctcaaagattcatcatctcacatcggtgaggactacgcttcgctcgtgtcgacatgttttgcccatggacggctgagatgcgaagaccagctttttgcaatcgtggatgactcgttcatgcgcgccattgagggcctgggcgtcgacactgagctcatccagctgattctgcccttcacacacggcctggagcccatggtctcggttaccattgaccgagacgagagagtgctcaagagccgagtcaatgtcggtgaaatgtactacgataactacgagaccatcaagggcgcttttgccgagctatatggctctctgactccccaggaacgggagtatctcaatgtcaagcccgagttcaacgactacaccaaggctgacgagctgtgtgactttgacgtgcgacacatgttgcgacaggcgttttccaaaaaacagattcgacaacttctttccattctctcgggtcttattctgctcatccacgaccaggatgacctggaagcctgttctctgatcgaaatcgatccccatgttcttcaggacgcgggcatgactcgacaacaggttatttacgccatctacgacaaactgctgcgttttattgtgggatcgataaatgccaagctgtcccagggtaccacaaactcgtcttcggcttccattcactcgggagacactctcaacgacgctgacgactccatcgctgctgtggtccactttctgtccattaccaaatcatcttcgcttgtgagacaacaaatgttcgacgtgaaccagggtatcaatgccgagatggttggcgacggactcaaacttaagtcttctcctgaactttttggagaactgtctctgcatagacctgttgatatctccgacatcacatccttcacacagtctcatttacttaccaaggaggcacgaaaggcctactctctgccagatctgtttgcctcctctcgtctgtggaccgtattcacccgagaccatccccccatcgactcctggaacgccttcaagcagggcaacaacttcaccaccgactttgatcatgaggagtttgtcgatcggtactacgatgcatacccgtcgctacagtctattctgcccctggacgtctgcgagcatcctctgagttactatattggactatgggctcgaaacaacgtcggatctgcttctgagatctacgtcggtcgagaccgagtctggatcagcgagaacacctaccgaaaactcgaagccaagtacgcggagttctctcagaccactcctgtgcaagagcagggtgaatgggctgctcagggcggtgacgagaaggctatgcttgagagtcactctcatgagctccattacgatgacaaggagattgtagacgaatctctgctcaaggatgtggatccggagcttggtgaaaatgttcatgttgaagagcagacgcgacagcgacgggtgtggatgactattgtctgggccatgacctggtgggtaccttctggattcctccatcatcttggacgactcaagcgaaaggaagaacggattgcatggagagaaaagtttgccattttcgtgctcatcttcttcctcaactgtgtcgtcattttctacatgatctttctcggtcgaattctgtgtcctgatttcgataaagcatggacagccaaggaggtgggataccaccaaggagaagacgacttttttgtgtccatccagggaaaagtctacgatatcaccaagttctacagacagcagcattctgatacctccatcaccacctctgccgccaacatgattccctttgctggccaggacatgacctcgtacttccccaatcctctgaccagtgcctgtcagggtcttgttgacgaccctaccgtgtggctggcttccaacaacaccatctacgaccctactgccattcactactctggagactacaagacctctgatactggatctgctctgtacaacctcacctggtacaatgatgttttccagcccagcatcgctcagtactacaagggtcctctggttgccaagagcaaggagctcaaggagaatggagaaaagggctggaacaagtgggttgttatcgacggctccatctatgacctgaccaactacttttacactctcgaccaggtcgagggttaccccaacaaggacgcctacgactttttgcacaaggatgtcaaggcaatggttgatgataatgccggccaggatgttactgacatctggaagcggatggatctcaagccgtccgagcgagttcagaacatggagtgtctcaagaacgccttctatgccggtaaacctgacttccgacagtctgcccgatgccaggtgtccaattacattctgctggttgttgctattcttctgtgttccgttgttctcatcaagttcctcgctgccatgcaactcggttctctagctacccccgacactcaaaacaagtacgttgtgtgccatgtccctgcttacactgaggacgaggaggctctgcgacgagccattgactccattgctgctctcgagtaccctgattctcgaaagctgctgcttgttgtttgtgacggtatgattgttggacagggtaacgaccagaccactcctcagattgtgcttgatattgttggccatgatcctcgagctgcttccgaagtcattccttacgcctttgagtccatcggcgatggtgctgctcgtcttaactacggtaaagtgtactctggtctctaccactacgatggccgaaacatcccctattgcatagttgtgaaggtcggtaaggagtcagagacttccaagcccggaaaccgaggtaagcgagactcccaggttctgctcatgcggttcttcaaccgagttgcttccaacggagccatgaatcccctggagctcgaaatgttccatcatattggtaacgtgattggagtggaccccggagcctacgagtacatgttcatggtggatgccgacacgcgtgtcaaggaggactctctcaacttcctcgtggcagactgtgtttctgacgtcaacgtggtgggtatctgtggagagaccgctcttcagaacgagaaccagtccatctggaccatggtccaggtctacgagtatttcatttctcaccacctgtccaaggctttcgagtctctgtttggttctgttacttgtctgcccggttgtttctccatgtaccgactcaagaatctgattgataaccgggttctggaggagtactccaccaacaaggtcaacactctgcacatgaagaacttgctttctcttggagaagatagattcctgaccaccctcatgactaagcgatggcctaaaatgcgattcaccttctgccgaggagccatggcttacaccactgctcctgactccttctccgtactggtttctcaacgacgaagatggatcaactccactgttcataacctggttgagcttctgcgaatcaactccatgtgtggtttctgtttctttggcatgcgtttcattgtctttattgatctcgcaggcaccctaatgctgccctctgtatgtgtctacctcgcctacctcatctacgtgattgccgcccacgccggagccttccccctggtctcggtcatcatgtttgcggccgtctacggtctgcaggccatcatctacatcatcaagcaggaatggcagcatattttctggatgatcatctacatttgcgcctaccccttccactctttccttcttcccatctattccttctggaaaatgaacgacttctcgtggggtaacacccgaatcgtggtcgagaaggacggtaaacagctcgtccagagcgatattccccgtctgtctgacaaggagttcaacgccctatgccccctggatacctgggagtcccatgcgcttcgcaacaacctccccatcttcgcacccgatgatacagccactgtatacaacgaagactaccttgaccagccggcttacaccccccgggcttcaaccttctataccaacaccatgaccaacactatgcgaagcaaccgaatgtcgttgttggagcagcaggagcagctcatcgagcaccgtcgcaaccgcttctctcagcttggagacagacacaactccatgcagtcgggcttcaccggtttctaatctcaagcatagtgagcaggctcactctttgtttatttataatatatttgcacttgaaccaggattgtagtttctcttaccaaggagaataattgtagtatctttgcatacagaagttgaagtaggccctcatgattgttggctcggtatctatacaatggctgaatttctcagtcaccacggaagtttttcatggagaacatctatcgtacaagcatagcatagtatgtcaagttaattggccaacaagtactagtaacgtgcggtacctgcgatatcacacggaaccgtgtatgtactacagtatagacccgaatagaacatgtacacagatcgtcttgaagcacaactacttgtacaggtagtttgatatgactcttctatagtatcagacattgtctccataaccaagtctataaatttattagctgtaactatacatttccctttttcctgcttatcgtcgcttcttggacttttcccacatggacgagccgccccgctttcgcttagtggcctcaccaatatctcctccaactccccagtcttcaccaaagaaggcgccagctcgagccttcttgagcttggatcgttctttcttgttggcgcccggcagacgcacaaagttgtcttcttcgtatcgctggacctcctcctctcgttttcggtctcggtctgtcttctctcctcctcgaccgtgctccagaatacccgaaccaatagactgctcgaccatgggtgcagaagaagagtactttagatactcttccatggtggcgttcttcttcttgctctttcgcatgctcttggactcgggagccacagccgagatcttggggggcctgtagatggtgttggaggcggactctcggtcgtcgtcctgctcggatttctttcctcgcgaatctcgcactggtcgagcattcttgtctcgtgtgaggttggaaacgttgggtttgaatgcaagattgtcgtcctcagattcggactcatcgtcgtcgtctctatcgtccttgtcgccctcatcgtcgtcgtccttctcttcgccaagaagcgccttctcagcccgttgcttttctcgctcggcctttcgctccttgtcctgtgtgtatgccttgagcatcttgtcaatctggtagttgaccttgctctccagacccttgatacccttctccagcaccacccggttcttgacggtgccctggatcgcggcctgtcgccccttttcaagagcgtcgtccttctgctccttctccacccgctgaacttgtgccagagtcacaaccgccaggtgatggaggtaggccagcattgtgtgattcttgagtcccagcaaggacagagagtcccgctggatctgggccttgacgtcgtcgtccagagcattgtacgcctgctgctcctccttgagcttggtagccgagttgtccgtagccgtcgtgatctccttcaacaaagcctccatttgtgttgtcttgatctgagatgaaattcccgtctgaacattttttctgcgcccggaaaaaaatagcttcgtcatgcagggtgggaaaatcttgcatatgcttagtcagcaaggtgggataggggattattgactgccagcattgtacttgtatcgtatttgtcatcatgttacgggccaaagagtgtgtatgtatagatacctatctttctacccgcttcaattcatgatatactgtaccattttcaacaatttatttctgcatgcatcaaccagtccttcattaaaatacaacaaaagtacttggaccaataatggacgacaaaacgggactattggaaaaagatttctaccaaacagtctataaaaacaggtggcatttcatttgcaccctttctttcattgtctatcactttaccgggtggcgtaatgactatggtatttttttctcataaggcgttctcaatggaagactaaaattgcttagtgcagttcaatgacaagggtaacaggacaatggtaggcaattgtgagcgaataacggcgaatttaccatcattgtagatggagcttcattattcagtggtaattcccgcttatctccccctcaaatattgtcttctacacctttctctgtgccctccaacctcagttaccctcctttcagataagaaactctaatagaaatttattcccaaggctttctgcgggaaaacaaatttctccttcacacaacatacacagcacaacatgcctcagaacgagtatattgaggctcacattaagaagcatggtcgaagactcgatcatgacgagcgaaagcgaaagcgagaagcccgagagggccaccgaatctccaaggatgcccagaacctgactggtttccgagctaagatgttcgccaagaagcgatacgccgagaaggtggcaatgaagaagaagatccgagagcatgagcagtccaaggtcaacggcacacccaaggaacacaaccccgaggatggtgatgctctgcccacgtatctgctggaccgacagcagcctaactctgccaaggctctgtcatcttccatcaagcagaagcgtctggagaaggccgacaagttcagcgtgcctctgcccaaggtgcgaggtatttctgaggaggagatgttcaaggttctcaagtctggaaagcgacgaaacaagagttggaagcgaatgatcactaagcatacctttgttggtgagggattcacacgacgacccgtcaagctggagcgaatcatccgaccctctgctctgcgtcagaagaaggccaacgtgacccaccccgagctcggcgtcactgtccacctgcccattctgggcgtcaagaagaacccccagtctcccatgtacactcaactgggtgtgctgacccgaggaaccatcatcgaggtcaacgtgtccgagcttggtctcgtgactgctggaggtaaggtggtgtggggtaagtacgcccagatcaccaacgagcccgatcgagatggctgtgtcaatgcagttctgctggtttaagagagcatacgtttctccaaacggactagctgccctacagccatatttatatcaggtggttccagtattctgtacattatacgcaccactcggtagtgttcgactacctcttgggatagactaactaaaataaacatgttaatggtttcttgttggagcattgtagaagcccaagtagtaccgtagatacgatccaactgtagtgtgaccatgggtgtgtttgtattcacagtactgggaattcgatgacaatgcactattattgctgggtacagtagagagaagcacaagtacactggtgggtaactcataactaggtcaatcgtaacgactgcactccactcgattgtaacacgctggatggacgcccatcgtataacaagttaagcatagctcttccgtatcgaactccccctccacgccagaatgaaacagtagtctgggcaatataacccctcaatcaatgaaccatgtaattatattgacaaggaaaccctggagaaagtgtggaacaaacatttcctccatgtacgaatgtacatacggtagtgtattttgtaccaacgccaacccagaatagagtcatcgaagtctagattgaccttgtattcgttagcctactccccatacccataaaagagtctattttcttgtcgtccttgtcccgtgggttctctcgatgctactgtacgccctctgtgaatgctacaatgggaagctgcttactaaagggtcgctagacgtgttatttagactgcgctcacataaacatagacacggtttcaaacgccgaaaccttggggtttgaaaccttgggtttcagaccatcaaacccagctaatggtctttgttggagttgtaacaaggactcacgggcaagcttaccgacggaaatggcctctctccgcatttttccaggtcgccacacgcccggtactggcttgtctgtgtctttgctttggtaagcgtgcaggacgaacatgtttcaggcgtgctatccacagccagcatgcccgccattcgacaccgtcggaaactcttgccgaacctatacggaccgcccgtgcactatctactcttgacttgtatacgaagggcaagcaggggtcaagtacgtcaatttcgcctgccagaatgcagccctagtctggtaatatccgggccacgtttaccaaactcaacgtctagtgccagaacaagtgtgggctattggatcgactacagagcattatcgtccctgtagctacagtgtgcttaatggtacgagtagtaattataaattataaaattatatacaagtatggaaccgccaatacacagtacaagtacattgtgtaccaaaaaacaactgggacagagaccgcaaggcataccagaccacgtttctgttggaatcgcccgtactggtaccgtacatattcgtacagacagacacatccgtcactttggtagacaacaaatatccttgcatacagttaagcaacacgccattatgacgtcaaaataacagccaagattggtgcttgaccgattagcgccctcatggaccccgtagtgctacatttccccaacaatgggcgccaagctccccaagtcgctaaaagctggccagccgtacaaacacgcatgctcgtctaatagatctacttctagacgacccctgccgaaaagggtctcgtgtctcgcttgtgtctcgcttgttggacataaagtagtggagacgggaagggagggctttccaggacacagtttggcttaattaccaagcttgttttacattctcgatcttccttcttccttgttctactgttcactctctggacagtcgtttcttcttcgactcgtgtaacctacaataagtacagtatgtgcatacggtacgaatctcatctcagtatagtgtacatactcacatgattcattaattgaaaactatttggttcatctcatcattcgtcggaccgccttctgacgcatgtcctcgcccttccacagcaggatgaagacgggaatagtgctggcaatgaagccaaaggcagccacagtcgacgtccaaccaatgccaatgttctccacggccttgagggtggaggcagcagcaatggcactgccgcagtttcgaatggcgtaattgccggaaatagcagcagcagttccgagctcaggactggagtcggcacagtaggcgttgagcgacggaaagtacatggacagtccaaagccaaccaggaacatggtcaccaccggaacagccactcctccaaactccttctccagagaccatccgtagatgagcatacagacggggagcaagatgccaacaaaagggagctgggatcgaagtcggtcctcgcaaactcgtcggccacggatcttggtccatcgctgaacagtcttgtccgcgtacatgcctccaaagtagcatccaatgaggaaacccacaccctgaggcaggtagaagagagctgcgacgacaggagacttgatatcgaaacggggctcgacaaccagagaaaggggagtcagcagacagtccatgccgtacatgattggaacaatggagagacctgccagcagaagatgcatgtttcggagacccatgagaaccttgaaggggttgatccagatccagacaaaccgcttgttttgctcagcgcatagcatttggtgcttggtggtggccatgggctcccggagcacaaaggtgacgagtagcaggtttgccagggcaactccggcctgcatccagaagatgactctccaggaagtcttggtgacgatccagccaccgataatgggaccaatggtcattccagattgagagccgagaaggcaggcgcccacagccttgcctcggtgctcaggccgccaaatatcggcaatggcagagcccgaaaccgagaaaaacgccgtacctcccatggcggtagtggctcggaagatgtagtaggaaacgaggttgggagaggcagcaataccaatattggagacaataaagattatgcaacaggtgatgagggcggcctttcgtccgtaggcatcactgaagggtccaaagaagcaggacgagaaaccggtgatgaggaagaagatagcgttacctacagtgacaatggtgccactgacgtcgaactgctcggcaatcagaggcacggcaggcaacatggcgtaggtgacgaggaagggctggaagaaacaaaaggccagaactgcggtcatgatccgcttttgcgacagagtgaaccggttgaacttgacatcgtcatcgggggctgtggcagggagagcttccacgtccagcgtgtttgtgttgctgtcgtcagtgtttgccgacaccggtccatctccctctcccgccgtgtcactcccgcttcccaagtcggaggacacagaaactctgggtagcttttggtcaatgctgtccagctcaatgtcaatggagccgccagtggacgcgaacgtttcgtctgccttgttcagaagggctctcatactcgttattgtgtggttagtgagcgtgtttaaaggcagaaagtggattctacaaggtggctgatcctcaacccattatatttgcactctgtgagtttttttttgccgcgccgttcctcgctatatgcaggttgtagcgagccgctctattttgggtttcgaggcttgctaaattcaccgataccttggcggttagacgggagaagagcgggtctggcggcaaataatcagatccagacaccaatctttggaatccgagtcactggggcttttttgcgcccaaattgaagcaagtgcacgcattttggtagctcgtgttttgtgggggtaaaatagcttatttcaaagagagtttctgagttgtcctctaagggcaggagcaagctattccattttcgcaatacgacgctaccggcagtgataaccgttggaataattgcttatcgacatccaccacgttacttacggccaaaaatggtcccgagaggtgctgatccgaaggcgttctggcgcttttacacgtgatccccacgtgacatgtaccacatcttgaaccttatgcagggttaaatctggtgctaaaatatttacactttcataaacgagacgtgagagtctggggaagggtgtgaatagcggctttgtgatgataaaagtgcttgcgggaaaaataagtggattctaaacatcgcagtttggtcacgtggcggaagtgctgactcgcagtagttcatcacgtgttcagcgtcacatggttcattggaatgatgccgttagccaatcacaagtggtggttgactaaaaaggactatacatgctgtcagatagtccacggtagagtgaccatacttttgccatctgccatgtctgccacctccaacgccggcgacacacaaaccaccagacgccggctcgtgagcaccctcagcacccctgaaactgtaagtaaccaaacaagccaattcaccgctgctgtacacacagcatcattattattcacaacatgtggtctgatattacgcgagaaaaaatatcgcgtgaagcagacagtcctcaggaagcgcgcattattatggaaccgtgcgtccccagtatgttcacttgtagtagcaattgcagccgcgagaggggaaccatgacagcaaagtccactgggtctttttcacactcaaggatctacataccccactgacaatcaccggtatctgagacttcagacttaaaagactctaccggacattacaagactctaccggacattacaagactctaccggactttacaagactctacaggactttacaagattctctttacacggccacaacttggagacactctccccaacctcaacagaccctccatcgccaagaatcacgttgctattgcttttcacataacactttagcacgttctgaaagggtgtaagaagcaatgctgatcagggtcttgacttagataatacggagctgcatggaaacccggcttcttccggccggaaatattcatcgctcttagtcatccctctcaagctcagaattattactcaattcatacaacgtgccaatgggtacattgactggaagtggcttgcttatagctatgactcagaatacaattctacgtccagtaaggttgatggtgcatccttctcaacaaaacataacttactcgtacatagtaccaatgactcatgacaataaataaaatccattaaaccgatatagagtcacgaagattcgagactcgggtcatcagctacacactctatatctcgttggttagttagtatgtacggtgggcatacagtagccctaataatcacagagtcgtcaagtgctctaagaagagaacttggactgctcaaaaacctggccgtggaccgcacgctcgtgtcgagcccggtttccactgtccacatgccatcgcgtggaacaagtcttgcttccagggaacttttccatgtctccctcacaccagaaccggcattggaacttggggtgtccatggcgtcggtcgtaatgcttctgggcctccagctttcgaacaaagccgataatgtgccacagacagtcaggcgactcgcacttgtagtgtcgtccggcgacttcggtggtgcccgtctccttctccaccttctggatgtgtgctgcaaactcctccaggttcttgtcgtagaaaatctcgtcgcagtgcttgcacttgtactttcggtttctccactttctgtgctttcggccgttgaagtccacctccacgggttcctcgacctctgggacaacctcaggcttggcagatacattcggtggttcgtgctcctccttgatggtcacggtcgccggcagtggggtcgtggacggttggggaggggtgattgacaggttcacatcgggtagagggatatcaatgctctgtgtcaatagctgtgtggagtgctgctgcggttgcaactgtgtctgcatttggccctgggtgaagtcgaacgaatagttgccgaacgcgtgctgttcctccttgatcacggtggtagggatgtagttcatgttgttgttcatggtgttggaaccagccatcagttgctgaacaaacacagaatagtcggtattggcaatgttggtggccacgttgggcttgctgatgtttcccgtctggttgcgcgctggaagagacactcttcggggctcaacataaggagcagaagagttgacatcggggaagctttggtctggcgggaagagcgaaaaatcatactgtgggccgttcaacacgtcgctgaacgagcgttgtggcactgctaattgtggttgttgctgctgttgctgctgctgtgtgatatggtctagggattggggtatgtctggaaattcatcacagtcatcttcttcctcttgaggggagtacattgggttgaccacaaatggtactggcgacagaatgtcgtaccccagacacggctcgtgagtatcacaggccaccacctcattgatatcaaaatgagagggcatcatcgtggcaggtgatcagagaagagagattgagagggtgtgtgtgagtgtgattgtgcgtgggtgtgtgattgaggctcgtgaatgtgtcggaagatgtttcttgagctccagattaaaggctggtttcgaggttagtatttcgttcttgggaatccccagcctccacaggaaccgttctctacttatatcaatggtcatagttggataacaaaagaggtgctgttagtgctgttagttcaattagctctatttgcgttgcgcacaagggcaggatatgtgcatgtgcaacaaagaaatccccaaagttgtcatacataaggttgtgcgtctaacctagaaaatcgcaaaattcattcggtggaaaaataaaaaaataaatttgacctcttttgcttttgccaaatctacggttttagtcagttttctgccagcttaaaagctcaaaaaaacgaaaaaacaggcacggttgaaaaaatatcacccacattcacgccaacaccacactcgtctccagtctctactactgtacacacatgttgcacatccctccgtcggatgccattactcagagcccccccccagtaaacacaaaacggttggacacatgcactgaacccgctggtggaaaagcatggtcgccgatggtacatgcagaagctccgacgacgcggccagagacgctgctggtccacactcctttggaccgaacatcgcgaagcgtcccacacacaggccatggcgagtctggagactcgatacagaccgcgggtgagattattatcccagtctggtgacggcaatccacggccccgccagagagggagggtttggatccagagtctgtttgtatccccggctgtagatggcatgtgggccaaaacgttgttgtgacaatgtgcgcggagaccgagtgaaccgaaggtgtgattgaggaaagagggagttcttagcgagtcgactcggggtatcgtctggtgtgctcgagtgtatcgagtacgagtacgggcacacgcctgggttacttgtagagaggggcgcagagtgcgatacgatggagagaacaggggtaatatgtgcaaaaaggcccatgtttcgaaaggtcaagagccgtcgtggttagctaaccttgccaaactgtgggctagctgtgggctatgggctaggtgctgtggtccgccctttcgtacgcgtcggttcacatatattgtgtactcgtactgtagctctctttccggcgcctctcggcgattcaacccaaagccctccaccgtgaaacggttggaggactgtggaggaggttggaagaggttagaggaggatgtctggcgggtcgggagactctcagaacggggagaatgagagtagcgacttgtgcagcgtgtgtcaagacgggagtgaggtgtctgtcagttagaccggctgttcgtcacatgactccatcgtcgtagccctggttgcccagaatgacgtcgtttaaaaagtctcaaagcacacggagagggtgcatttcgaacgtggttgtagacttttcgaaaccttgcccaaacaactcggatctaggattcaacttaaaagaccctaaaaatagtgcatccacactccttcagccgtacaccgcgcgctaatcaatattcaacatcagaccatgattgaggttgtgtctaggcgggctaggcagggacagggtggaccgcagcatggtgaggttggtgtttgaacgggctgaactgaacggaacggaacgagaatctgccaagtacaactagtggacaactaaaagtatcgtacttgtacttttgctcgtactgtacccatacttgcatggcgatgacggtgacagcgtccaaaaacatgggcctagcgcgagtgagtcaactccaaacaaacccccgatccttgtggcaacagaccacggtccgagtagacaaaaactgagagacagagcagagacaagagtcgccaccgactaaactttggactccatcctgcattcccctgcctccctcccgaacttgtcaggaccctaatttcacgctcccaatctggaaaagttaagcgtatattcgaattccacatgaggaatacgagcgtgacaaaggtttcggagattccgtacctgtcacggagggagacggaggatttgacggaacctgagagggacttgactttcccagaggctccttttgccagaatgatggaatatgtacaatacaagtaggcatttaaacataagagagcgccgggctattaatagacagaagcgacgggcgattatacgagcatctgatatctcatggcggggtcttgtcttggctacaaccaacggcactggcacacggctggatcgaacttgcggttgttgattgtgtcacagggctgcgaggtaattgcgttggttagttccgtgactgacatgggtttcggaccccgaaactcactcaccgaggggcgttggaccgcctgtactagctaccgtactactaccgtccacagcactaccttgcaacagcaagctcgtagggcgacacagccccgtctcgtgactggagctagcacggctgaatcacggggtctatcgagcctttggcatttgttgccagggccaaacaaagacggtgaggtcttgtctgaggcttcgttagctggggaaagcgagctaaaggccaaacccagacagttgggcagtcaactaaaaagtcgactaaaagccaaaaagccaaaagccgaaataagacaccatttttttcttgttgaagcaggtttaaccccatttggagccggggaaaacaagcccataaacaggcaaccaagcctttgatgagacatgacaacggttctgggcctctagaaccggccgtctcctagagaaggccaccccgcatttatcagcgaccgaccacgaaaccacacaccgaaaccatcccgtcgtcgtgctctctccatggggcccttgtttggcggttttaattaccgcccttgtctcctctgctggagccagctgttgtctcactaatcagcaaagacgtcgacgtaccccgtatcctacacaaacacacaacggcggttgatgcatggacttgctgacgtcatgcacggggccctcagccctggacccccaaacccttgttattattcggtgctggacaagagcgtcacgtccaaggctccgcctacagctagactctcaaaaggcaaaaggacccacgttttagaatgtattatcgaagctaccaagaggtatagaacacaacggcggccagagtttaatctggtggggtgggaggtatgataaatggcttacatggtttcgatagatggttggataactgcgtttgttagtcataccaacagtaagttgggctcgcactgtagctcgtgaaagacatctcgaatgtctcgaattaaacaaaccattgactgccattataaccctgctgctggccaccaccctagattcggcctcgggctgtgtactgtacatactgtacgatactgaaccccaagaccatatccaagatccaatacaacctcccgtttagccgaccaaagacatgcctctcaaacgcaccccgtgagccacggcccaaagtgttcgcctccggaggattctcgtgatgagccctctctaggtgtctattatgcaggtctcggcatggaccgaccttgtgcccacactgctcccgtcaagagcctttcatcatcacttggtggcaaaagcaggacgctaaccaagacctaaagtagactcgctcgtggtctcgcgtgtggcaaatgaaaccagcgcaccaaaccatctgtaccgttgaagccaagctcggtggcataaagatataatatcgtctcttgtgttatatcgtcgtctcgacactacttacttaccgtagactctattggataagacaaggtgacaaagcagccaagccttaatgtcgatctagcaatgcacaatcggaaatctgacaagacagggccgaaactgtatccgggcctcctggggccgctggactcggtcgtcttgtcgcgctccaatcttcgtattcgttgcgctcgccaaagtcaaccctcccacggtggcaaaaggcggcaaacctagtcggtcaattgactttggtctcaacatgacgtgggccctttgtctcatgtaccggtgtcagtacaacaagttccggcgatgattcgtgccagcttctgtacagtacaccgttagatgagcttggctcctcttggccaaccacaagaagggtgccatgtgtaaccatggcctcccaaaggaccattgacccgagccatctgctcgtattctcacactcggctgcaaccagatcaacatcgccaccaagtagtaaacttcgatccgactgccccatgatctatttgtcagactgtcgcagcgccgtgtcgcacacccacagccagctgtttcaccctgtccccggcgctttctttttgcagttgccaacagatgaaaccgtctttttggcggacgcactccatggttcggcaagcggcgccagagtgactatgacaggcagctctcatgtaaacggtgcacgcacgttagaccttgtctcagatgagtgcaaagtacagcatgtacaagagagtatgtactgcggtcgccctctccacagccctcattccacacagaatcgaacctccatcaacatgcaagggcgtgctattattagcagcagaaacaaacaatcgattcgacgcagccattgtctacagacacgggtggtggtttcacgatacaaggcacaagtgagatataatgtcaatattaagaaaggtaaaagtacagagtggattatatttagaatgcctcgattcggtccctaagaacccccttcaggccttgctgctgagcttggatgacaacccactggacggccgcagctgaagctcgggaatgagaatctcgtaggggttggtgtctccactgggcttgctgggatcaatctcaatacgcagagccaaagaaagagacgatggaagagcctcgatgggaagctcctcctcgacaggcttggagctgatgtgttccaccttcttacccgcatgttgactcttggatcctccacccatgtgcgtagtgtagtctccggaggttttaaagtcgggccccattggacccggacgtcggttctcgccgattcgagcagccttgggatcaaacttttgtagattatccagctcaatgatggagcaccagtttcgccggggcaacaggcgcttgttgtttctgtgagagccatcgacgtcgcaggggaaaatcgagaccatgttctcgtcggtcttgaagtcgaaatgatgcaccttgttccgcttgttaaggaaatcggccatggtgtccggaggaggtgtgttcacaatagctgaagaaatgacgttcagcatgtttctatggtcgttgataacggggacagacaccttgtggtgcttggtggggttcaaagacttggtatagaaccgtccaatgccagccagatgcacgtctccagacagaatcgtgattcggaccgagtacttttgggcaagctcaaacaaacgctcaaccaacgcatttcgctccttcttgtgtcgctgagcacaccaatggtcatcgagatcatcaagaatctccactcggccatcaaactcgttcaccagaccagcagcaacgactttacgtctagacaggtatctgataggggccaacagcggagaggttagcagtctctcgagccagacgagtcgcgggtaggccatggggacaccgatcataagcagcagatgcttgatctcgcccttggcagctgccagctccttttcgatacgctgaaagttgagctggtacgtctctcgagtgataatctggtcaatctttcgttcagttcggcagtccagaccgtgaaaggcaatgctctttccaagacgagcatagatggatcgagaccgattgtgaatgtagggacctgttttggctccaagcacccaactggggtcctcaacgtcgtcagtcaggttgtctcgagcccctccttcaatgtcaaccaacgtctggttctgaaacaacatatagtacttgtaggcgactcgtccgatacctccaaacacaggtccagtcatggttttctcaggataggagccgaaaccgtcgataatgtcgtgatcatcaaaaatgttgatcatgggaatggatgcaaacgcaaggggaaggttggtctgctgggtcgagcccttggggcctctccagaatccagctccgaaccaggccatgtagtggaacaggtagaatcggtggagttcgtctctcatttccggcgtccacttgattcggtccttgtggccatgttcggcctcgatccactccttgaagtgctcggtgtactgtttgaccgagtcgcagtagatctggtctcctcctccgagcataacgtggtagtgggccttctcgtgctccttcatgacgtctgtccagagggagccattgaacacagaggggtccacacccatggagaatccgttgcacgagtggaaaaccacgttcatggactgctcgagagcaggcacgaagaagctggcagcagcagcctcctcgttgatgcggtagtgcagtttctgctcctcgttggtcatggggatctccacggaccatctccagaacgagatgcccatttcggagaggatgtttttcgcctcaagagtgttttggaagccattggtggacgtgattgtgagaaagggggtggtggagaggtctgacgacatatcttcggtgcagatcatgatggttcctcgccagacgtctgcggccttgtcgcgcatgccgagatatcgcagcagcgggccacatgtgattttgagcgggggagaccctcgagctgcgttagtaagtggtcattgggacactggcaatgtcgccagagtcgctgtacggtcagaaaaagggtaacttacgaacaacaggaggccggctggtttcgttggtaagggtctgggttagcggggagttctggagcgagacgcgcttgaagaagcgtgtctgtatcgtggacaagttccactcaatccgcggtgggtttacccccaatagcaactcacactcatgtcaatggtgataatgaatactgctgcattcggagtgttaaacaacccatcatgagctgcaaccttaaattatgcatttgggcaaaacaagctgggctgggtctggggaatgtgacaactggggccgattattaacatgacatttgtacggaagacagaggggactcggtcccgcggggggctcgttgacagtcgcaaaacctgcatttgtgtcatctgcgttccccggcttgccaaaggcccatactgacctggagtcagcactatagagtgttgctgattcgtgcattctctcctctattgggttcggacagacgtatgggggtatctcaggggtccgatggagagacaatacaaagaaaagagtctccaagatagcaaccaagacaacaaagggggtttattatgaagctactcagaaggtgcccaggatttgtggccaagggagatgtcgggaatgtgagaattttgggggttaaaaactgcgcctccatccacatcctccaggccatctatttttggattctggagaacaagtcgattcacgcacctagaccaggttaagccttaacattagcacagccatcgaacgcttttttggccctgtaacggtcaatcatacgacaagaaggtggagtacgagagacaaggagaatcagggaaaacaatcaatccgggctgagcatacgacgggtggatatacacacgtcgacctgacccgtcgtatgctccgcctcgctaaagcacagggacttaacccgttatcgacaattagttacaagcctgcatggtgatactgtagctgatagtgaatatcgtgacagccagccttgtagtttcagcgaactaacgattaaatagctcattaattgtaaacggagtaaaatagagaccaaataccgagtctgtggtgcatgggagtaatgtgaaacaaacatgagagtgttctaacatgctcataggcttccgatgctctctgctctggctgcagtatctcagttgaatggtcacttgtctcaacttcttcttttcaagtcatgtaatcacacccatctggagtaaacaacttccagtatggtaaatgtgtggggagtgcaagacactcatctcggtgccgtcaactgtaggtctgtggatatggaaaccaaacttttcacttataacccagctgagtaccggtacctgtattcgtactacctgtacaattcatctcgtattgcgcttctaagttcttagtcatcagttcgttcgtcaactctgactgtctcgtatggacatgacggaattacgcattctctacgcacatggggcacgtccagccacaccaaagtcctacgtacatcccatcatatacattatccacaagcaaagaacctaaccagcccacacttgcattaacagtgcctctaggcagccattctgagaagacgagcccagaaagaccgccgatggccgagaactacagcaggtgtcttcccacggctcccacaccagctgatcggtaatcgacacgagccgccttggaaatccgtggaattttcggacatattctacagctgaaaaattctcctgttggagaaaagtgacaaggtttaagcgagtttgggttcggtctggaaaaaaaaatttcgtgccgcaaaatatcaaagtagacgagtactgggactattttcagcaggaaaattccaaaaaatctaaaatatacaccttcttaaacgataccacacgtgtattttcgctctgccattaccatagctcatttgacgcgtgatattgttatttatggctccctttttcctcatgcatgttaattgcaaatgcgcatgacaaacgcacatatctttctacctgggctcttctcgaaacccaaattgagctctccaaaaatatataaaccccccctagacccctcctagaacagcagaagcgaccagtctctgggcagcagcaactgcaaaggatgcggtaccttctgatggacggtaggtgcggtagagcccgctgaaatgcggagctgagaagcaaacctgtcccaccccaccatgcaacgatggacttgattgatgacgtgccatacacagcttagccagcctacgcacgagatcgtccgcttgagtttgggtagcgcccaagggttgtgatatttcccctgcatggaaagatacacatcaccacatggtcaagagccaatgccttgagagcaatgacgcgttgagacacacgcatgagcccaagagtgaagccgcctgagccaagagtcaatgagtcctacgggttgaccgcttgtgacagagtcaataaatccttcgggttgacctccttgcatgagtcaataaatcctaccacggctgaccgccatacgctgaaacatgctatgagccaagagcgaggtgtctagagccggctgaaatgccagagcccgcctccgtgccttgtgtaacacacatgagcaagccgccagagccaagcgccagatgccatcgagccagagccaccaattcgaccgttgagaaactcacagggtggaattcctttttgagacactcacgagagccgcctagttaacctacctgagcaaagcgccagagccacgatgccagagccgccccaaagagccaactgtcgagagacggccaggtaaaagccgagaagctgctgagacgctaccatgccgagaagcgggctgagacgcgctagagcaaagatctgcttatgacagacgccattccaatggtcaaaagagctatgcaacagttaacgagcccgcgccacacgccgactatcaagtctgagcgaacgccagagccgccaacgagccacaccatgatgcctgagtcagccccactgaggcaataagtgccaaatccagagccacagacgagagcaaagagccggtaagtccaaagatgcaataagagccaaacgccagtcaccagccagagcaagagccagtgagtccacagatgcaataagagccaaacgcctgagcgatacacgtaccagagccaaaggagccagggccatcgagccgaggccagccagatgccactaagagccagagccacaacgagccagttgccaataagagccagagcacgagccagagtcacacaagatgttgcagtcgagatgtgtataggacgtaggcagttgaacctcttagcaagaggatgtaaactgaccgaacctattatttagttgagaggagtaggtgaaaatccgaacctctgggttaatatatcatggaccaaagagtccccacccaatttttcaattgtagtgttattgtagcatttttgtgtcgtggtaatttttttttttagtaatttttgtaagttttttttctgtgtgtaagtacatgagtacgtgctagtgatttagctactgcacttgacatacgtacttgtacagtacttacggtatgtacctcataatctcaccacccagcttagaaaagtgtgtatatgaatcacctcagctccaggagtcatgaaaaagcccctactgtaccatcagataagtacatactcgattacgttgtacaatacgccacaatgatgcaaccccttggcgatgagctcatctcagggaactctaacagaaatacttaacatacgcatataggagtgtcgtgggtcattgcatacaaaaaacaagtacaaatgggtgtatccaatggcttatcatggacactatcactccatcattctgtcaaccaagtttaccctaccgagagagacatttctcgtcgacaggcaactaaaatattttctgacggctattgacgctgacgacatgtcccaacagggtcacgtgaaccgtgcggcttttctattgaggagatgatgtagagaaagaaaagtaggaggtggttggattgtgtagcgggagttgttggccttgggactcgtttcaatccgacggtgtatcacatgaccagtcagattctgccattacatctgcttcacggtcgccacaacagtagcaattgctcttgtcccaacctcgtcttactcagttcttcactgagtaaactgcaagctcaaatcataatctccagtcggaaaaactcaacacatttacaccacacactcgcacacacatacacgcaaacgcctcactcagatgctcaagcgacagctccattccgccagcaaacggtcggccacccgtttttccgacgcactcaacaagggcccctcgttcgatgactttctgaccggacgagcaggaaaggcagcagccgttgatcctgtcctggcagcatcgtcagacggaaaacgactgcccaagtggctcaagacagaaattcccaagggaaagaacctgcacaacatccgggaggacctgcgaggtctgggtctgcacactgtgtgtgaggaggcccgatgtcctaacattggagagtgttggggtggatcggacaagagcaaggccacagccaccatcatgctcatgggagacacgtgcactcgaggctgtcgattctgctccgtcaagacaaaccgaaaccccggccctctggaccccaacgagcccgaaaacaccgccgtggccatctccaagtggggtctgggctatgtggtgctcactactgtggacagagacgacttgtccgatggaggatcgtggcattttgcagacaccgtcaaacgaatcaaggagaaggcgccccacattctggtcgagacgctatctggagacttccgaggcaatctggaccacgttactactctcgccgagtctggactcgatgtctttgcccacaacatggagaccgtcgaggctctgaccccctttgtgcgagaccgaagagccacgttccagcagtcgttatccgtgctcagacaggccaaggtggccgtgcccgacctcatcacaaagacatctatcatgctgggtttcggagagaccgacgaacaggtcgaagacactcttatgcagttgcggggcgtgggtgtcgacattgtcacctttggacagtacatgcggcccacaatccgacatctgaaggtggctgaatacgtgacacccgagaagtttgactactggcagaagcgggccatggatatgggtttcctttactgtgcatccggacctctagtgcgatcttcgtacaaggccggcgaggtgttcattgaaaacgtgttgaagaagcgaaatgccgccaaggctgtctaaactactccggcttactccacctaactgacatatatatttaatctcctgaatgatagaagaacaagtttcatgtagatcttcactcgaagtacttgtagcaggcaggcgcaatgtacttttacaaggactttactccatatataatgcatgtattatgaggtctatgtgtgtgctacgttttgcttcgtttgggctgaccttcgtagtcccccatctcactgtctgcatcactctttgaagtagaaagcacaggtttccgcttggctcgttttcgatcactgagtttcacattctgaaccgacttgacggcgttggatagagcctccagaacagtagtgtctttgacatgcagattgatgatgttggctactgcggccagctcgcagtattgtgtatgcagttggtctctgagcgcttgccagtctcgctgaccgtcgtccatgagatattcgtcttctcggtccgattgcaggtcctccacgtcgcaattgagacggacgttttcgcgacgtagttcctccacttctgcctgcaaggtcgattcggtctcttcgaggcgttcagcccatctctgagtggacgcgagttggctctggatctctccgttggttttctccagcttcttgatgtccttttgcaggttccccagactgctcttgagttctgcgttttccgccatgatcttcttgcggttctcttttcgctggaactttttgtcgtcaagagaccctctcagacgcttgattgtatctcttctacggtcattgatggctcgtagtcgcgaggtttcgtcctcgtgggccagttccatgctgttcagaaccgatgtgactctactgagctcctgctgcccagcaatatgggtttgttgaagtgccagcatctctttctcgacctcagcgattctggcgtcagctctggccttctcagactgctccgagtcgcgaagaagctcgaaacaatacgtttctgcattctccttgaaccgagcagcctctgcgaaaacagtctggtgaacctgctggcactcgggggagcttgggtcggacaaggcctggactaggcgttcgagatgggctacctgctggctcagcaactggttttcgttagtcaatcgctccacaatgcggaacggatcgtctgcctcggacgtcgcagtcacactggcagtcacgtcagccgattcgtccattccatacggaggaggctgttcttcccagccagtcatgacagcgatgtcctagattaatcgttttcgtttgtcgtttgtcgtttgtcgttcggtggtttagtttagtcgtttggttggtcttcgcaaatcggcgtttctccgtgataattgttagatatagcgttgtagactgtgcggatcagttttgaactcatcaggctggttctcgatacctcaaacaggaggctcatctcgctctcagacggcaggaccataacatgactgatcagatgagcaggataagagccacaggaaccagccctcatttgccaccgtcgggaaagtcggggcagtggtctcccggtcacatgactggcgttgtcatttggtatctagttcatgtgtgtgtatatcatacagtcatgttttttgttggtggtatcttttagctacatatcttgagcacacatgatattcccaagttgagtttgatggtgagttcgatgtgatctaccatagtccacacagtacatagaagaataccgacacaagaacaagtactcgtaattcagttgaacttgcgaacttatgggggactttgacattacaatgcaaccacaatactgtatgtaccggtactgtaggagtacttatagttgtactttttcccacatctctggtcaaactttttttttcttttttttttcttcatatcatgcctctgctgaacacaaccataacgattccctaccgccatacctctccaaaactccaccccagggacagcggttgtcgcccacgagcactcgtacatacattactccgaaaatacatccagaagcatccagaaacatgttttccacgtttgaggggctcttgtagacgccattgcatctaacctgcgtggaggttgtgccaaggcgagccggtacgagtacgacacttgaagcatacagtactgtaaggattcaggactcggtgtcaaactgaaaacgccccggacgcggtccatagattgcacgggtccgctcttatccgctttctccacctccacccggccggctttctgtacttggacggtaggttcaagtggtagctgttattccttccaataatggatatttggatccgcaaccttaagaggttcgcttcggagcgcgaggttgtccagtatagtgtggatgtatacagtacgacgatactcgtgcctgtatggtgcggtggaggttgttcaaagggcaggtcgagggagatgagagttttttcgtcacgtgatggggtcacattgactgctctggaaattaattgccaccgggcacggcgctcatgtgagcacttctccccgcttaggactgctgcaattgggcatactccaagcgagtagctaacagacactctaatacaagcggcagagcagcgtgtttcagtttgggaaggtctgaaaccaccggttgggctcatgaccgcggatcgcacacaaggaccaacagcggtcagcagcccgcggagcctcgtaacaacgtctctgtgtgcacacaagcgcgtccgtgcgcggcctgttgtatacgttcgtggcgaacttgctgcgcggttgctgttgtcatgcgcgtggcgggctccgattacagcaatgactgaggagtgtgtttgggagatgggggccgttcagagcggcaaaagaagaatattctacaggttttaaaggaagaagtcaaagtaggactcaatctctctctcctgggctcctcttccagtcatcctcatcaatccccgtggttccattgggacattttatccgccaccccccgtctggtctacatacggcatcaacctaataagcccagatatactgctttaactagacccaaggcacagcacgcagcgtagtaaagtttggatcgccgtcagggctaccacttgttaacgcactgcttgtttttcttctcttttcaccaaactcaacccatcgcgaaatgtcatatcccgatcgaagagcttcgttcggctcgtcaccgcggcagtctgccatccagcggctcggaacccccgtccaggtcggttcgcccaactccaacccaggctcggtgacgggctccttcaaggactcgatgcgagagtccatgaagcggttcgaggagcaggccgacgccaacaaaaacgtggaggaggtgactttcaacaagcgaacgcccgaggagcagcacaagaacggcagcgactcttccaagggaggtctcaagggcctcatggacaagggcaaggaaaaggacgatgccagcaacaagacagactcaaatacgaacacaaccaccaagaccaccccgtctaacagcagcaaaaacaacagcaacaccaaaaccaataacaacagcaacagcaattcgtccaacgacaccaaaaaggatcaatctgcttctcctgcaaacccccccaaccccgcagacgcagacacccagtcgatccactctgtggacattgacaaccccaatcccgaggtggtcaaggctgtcggccgacatctcgtgtctgacgacaagaccagaaactacggagccacggaaagcgaaaatttcgactccctcaaactgcagggaggagacatcacccgccagctgtacaagtggcagaaggagcacgaggagggcggactcaagcgatccaagtcgttcgatgccggcgagggagcctcctcctctgcgacccaggaactcggacaggatatcaactctatcaaggcccccggaggattccgacgaaacttcattgctcaaaaggtgcagcaagaaaacggccaggacaaaccccccaccttcctcactcggaacttcattgagttcctgtctatctacggtcattttgccggcgaggagctcgaggaggacgacgatgacgacgatgatgatgactacgacggagacgatgaggttgacgagaacgactacgacgaagaaacccctctgcgtcgaagagcccgaaagcagcgaggtgccaagcccggccatcctccccagggtaatgcatctgctaccaaggctgtcatgttgctgctcaagtcctttgtgggaaccggtgtgctcttcctgcccaaggccttcttcaacggaggtcttctcttctcagcctgcgtgctcaccatggtggctgctctctcttactggtgtttcctgctgctgatccaatgccgaatgaagactggcgtgtcgtcctttggtgacattggtggcgccctctacggccccaagatgcggtctctgattctcttctccattgttatttcccagattggttttgctgccgcctacattgtgtttacgtccgaaaacttgcaggccttcattctatctgtgaccaagggagagacctttgtcaagatcgagactctcattttcctgcagctcattattttcctgcctctgtccatgattcgagacattgccaagctgtccggaactgctctgatagctgatctcttcattctgctgggtctcgtgtacctgtactactggtctggaatgattgttgccacagagggtgtcgctgatgtcaagatgttcaaccccaactcctggtcgctgttcctcggtaccgctatcttcacctttgaaggaattggtctgattatccccatccaggagtctatgaagaagcccgagcagttcacccccgtccttgctggagtgatggttggcatcactgccctgtttgtgtccatgggagctatctgttacatggcctttggctctgaggttaagactgtcgtcatttccaacctgccccaggactccaagtttgtcaatggtgtgcagattctgtactctgctgccattctgctgtccactcctctgcagctcttccctgccatccgaatcatcgagaatggtctcttcacccgatcaggcaagtacaactctaccatcaagtggcagaagaacattttccggttcttccttgtgtttgtcaccgcctttgttgcatggggaggtgccgacgatctcgatcggttcgtcgctctcaccggatcgtttgcatgtgtgcctctggtgtacatttaccctcctcttttgcattacaagggtgttgctcgaggcaccacggctcgaaccgccgatgtctgtattttcatctttggtctgtgtgccatgggctacaccactgccaacacagttggttcttggattggcggaaactagatgataccatccgctgccgcttttcatcaagcaggtgcatagacttaaatatttagtaaatgcacagattatattggcctgtgtaagagtgtatatgtgggggatgttcgcattatcgaggtcattgctctccatgcaacggaagtcggaaccagtcttactacccgttgaagatgcacatctttgcattagtgtggaaaggtgcatataagcggaatgtttccgcccattcataacaagtgttctatagatggggtaatacagagtgagtttatgatatgatcttgacaaggcatagaaccgctcttctagtgaagttgacttccgacaacatccattgctcgattcaggcgagggagactgtggtttcagttcaatcaatgccaatgtaacatagtgtccaaagcgctttagtttagcgcgttctggcctgtgtgattatataaggagggagatgttctgattgttgtctactaactatcaattccggtcaagaaatcatgtctgtcacatcaacttctctcaatggaaccttcaacggtatctctgaagacggtatcgagatcttcaagggtatcaagtacgcaaacattccgtatcgatgggcgtatgccgagcgaatcgacgactacgataatggcgttttcgactgcactcaggaaggcatggcttgtccgcaagtacttcctttcgactacaacattgaaaaggggcccaaggagatgccttttgatgagtttgaatgctccaatctcatgatcactcgaccccaaggcgctacaaatcttcctgtgtttgtatggatccacggaggaggaaatctggctggaaatgggtactgttccgatcacaaccccgttcctttcgtcaagcactccattgtggctggaagacccgttcttcatgtgatgatcgagtaccgtctcagtgcctttgggtatcttgctgttccggacacaaatggcaactgggttggcaattggggtgcccgagaccaatacacagccttgcaatggatctccaaacatatcgtggagtttggaggcgacccttcccagatcaccattggaggagagtccgcaggaagtattggacttcacgctctcatggtgcacgagagtatgaagcccaaggaagagtgtattatccacaatgttatcctctcgtcagggaccatggatcgaatgggtacggggacaatttcagagaatgcttttaagcccatctatgacggtatcaaaactctggttggagatatcaacacctgttctgcggacgagctgttggaggctcaaatcaaagccggcctcgacctcggcttttacctccaagacgacttcttccctccagactggagaaacgtgcggttcaaagtctctcgggttttactctcggacgtgattgtggatggaaccaacttcaagaacaagatcaatccagcggtacgagtaactccagagaacgactttgaccacaaggtcttcaagctctacaacatatctaccgaagatacatgggaggactaccactataagatgatgctatttaagggagacgagacctttattcgtggaaaccagcagctggaacttctgtttgagcaggaaaatatccccgtctggagacagttgttcgaccagattcatccaaatgaccccagtcgtctctgccaccatgccgtggatctctattacatgtgggacaactgggagatgcctgaagataaacatgcagtggcccgtcagtaccaggacactctgaccaagtttgtttacggacaagacccctggccggtcgacaagctccattatgtccacgataaccagtttgagatcctagacaagtctcagtttggcgacttccgcaacgttccagccctcaagtttctcttgggattctcagccgaagagcttggagaactcacgaaaaagtacactggagagggtcactacacgttgtagggttcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggacgtgactacaacagcctgcctggtcaaccacatcattcatgttgctgatgatcttctgaatcagctgaagagggtactctgtctcaatcagatcaccaaatttggggtgcagtagggcacatgatcgaagcatgagtgcagtagtagcacaataagtcattcgagcaaggtagagagtactcgacgacagaatctgcattgtgtagagctccgagaatccctccagggatgttcgcaccgcatcggcagtggccatggcactattgatcactgcgggggtcagtttgagatcgaagatgttcagaccaaactcggagaagggcgttcgaggaacagtgggtgacacgttcgtcaacagagatagttcatgcagagagatcttgagagaagatttgaacaactcgagaacgtgatcaattgggaaccctcgcttgtcaaaggtgaacacctcgtcgattcgacggtcgaaatgcttgaccagccgctgagtacgttcatcattgatatccagaggcttcttgtaatcctcacttctaagcatggccatcatatcttccaactccttgaacactttggccagcttggcacatctgatctcattaatggttgaatcaggtgtggaaaagaggtcacagcattcctgcagataggcattccatgtgattgtgacaggtttcttcaacagagaggacatatttacctgctggaagtagatgacgagccacagttttcgacactctcgcgacttgggatccatgacaatgttgggtctcatgatggattcataagagtcaagggaagacactcgcgtgaaggggccgtcgttgataccaatatcattggcgattgaaacggccatggagatgagcaggtggtacttttggttgaacgcaagctcgcagttgttgtaccagatcatcatgagagccagacactgcaccagctcgaacgatttggttcctacaaccatgatttctgaggtaatacttttgtagcattccacattgatttcgatggatgtgttttggaatttgggtccgagaatagcgttggaagacgagttcatgatagccaagaatagaaacggcttagttgatctaagctcgtctaccgaacagtcatctggaatcaccacaataccatacaggcactgcaaaacggatctgtactgttgcagtctcatatccgcctcctcttgggtaatgactcctctcgcaatgatatcattatgaggtcctaactgaccgcagtatgcatgagtagtgctgtggatgagctctgttctctttgcacttagctgaaccagagcgttccatgtcgccagcgtcttctgcttctcgtccacgccatcgattccggtctggaggtttcggggattgttacctgacgagttctggacttctctgaacagtcggtctgcagctgctgggagtcttggttgcaggtctttgtttcggactgagaaggacgatgctgaggtcggggttccagagctttctggcgttcgttccgactgcgttgtgggagacgggttcagcatgcctgcaattccattgatcggcatctgaggggggatgccaccgttaggaggcgtttgtccgtgcatctgcggcgattgcatgtggccatggccctggcctatagacatgatatggcccatgggtcctggttgcggcagagactgcggaggtaactgatgctgttgtggctgcgtctgctgttgctgttgctgttgctgttgctgtggttgtggctgtggttgtaagggttggtggatcatgggctgaccttggggagcgcctgcagccgcggctgaggcttcggagacctgaaggcctcggctgagcatctccagcttctcctcgagctccgcaatcttgctgcgcgtcttgggccgccgctttcgtcgcgcattattcaccacacactccttgttgaacctcgcgcatcgggcacaaggcccacctggatctgccgagtcgctgggcagacacttgaccttgagggccctgcagttttcgcaggcccgcggacggcgcaatttttcgtccatggcggcgtcggggggtataatggctgaagtcgggtcgttttttctgttggactcgatgagtaatcttataccctctggaaagtgccttccccaccttcaaatagttgcaatggaagcgagccaaagtttacctgacatgcagaaaaacagcgacagaacaataccagcccgtcaactaaggttcccctatgtgatgcaacaggctggacctggcggatcgatagcacacccgggactctgtagatgcacgaccgggtctcctcggagaatgggttcttgtaaatgcgaaaaacacgctggaaaaagctcgttatctccacggagtcgccctcctgctggaatacgtcatgtccgaaacacacgtgaaatcttgcaaaaagataggcttttacaatcataactccagaatcgtcagtgtgagacttaatcgtacatattcttacgtaggggacccagaggcaacggcggtagctcagatcggagtttggctgcttctccgagacatgcatcgtggccaaactccctaagaaggctctcttgcaccctttccacccaccggcccacgcccaagataaccttggagaagcctgcctcccacagtcggcatctattataaaaccgagtccggtgctttgtacttgtacttggactaaataacacaaacaagccttgcgggtagttgtaattgtaccgtgccaatagacactttgtatggcacagacacatatttcttctatgcattgactgacagcgaagctgcacctatgtgtgagaaaataaagtgctttgtgcgtaccagggatagggtaggtagtgaaatctgagttagtacatcaactctagacgatgggcgtcgcctgtgtagaagaacaataactcacccggtaactaacactatttctcggtggtcaatgcgtcagaagatatcaagacggtccgttttgcgtttaagccgagtgaatgttgcctgccgttagtaaatttattatgaaaaaccccactatgaatacatcagcctatactgatataccaagaagtgcaagggaggtggtcctgttccacctgaacgcggttcccgacaggcggcggtactgaagggctttgtgagagaggtaacgccgattctctctgcagtcgtaagacccaggtggtgtgtccgaggcagtatcgctttcccaactctagtaacctcggtagtgtgagacacactacccctaacggtaggacagccggacgacgatggcgcagcaattggcgaacgctgttataaaacaattcacttacgtgcaatgaaagttgtttgggcaataaacaataaatgtattagagccagacgatagacaacaatccagcagatgatgagcaggaaaattgagtaagatcgacgtggcaagaagagttacagttacgcagagttaataaggtgttgggagattagagttaccctgtcggatgactaactctccagagcgagtgttacatatggttgtggtgccagggcattgccggcttggatctgacacttggcgaccttggcggccgtgtcctataatatattgtcttttgtctctgtcgcaagacaagacatgcgttctagacacggtagcaaagtcggttttaattgtacatgccgctggtggtcccgatacatgaacactcgtacttcttgtacgtcattccacgcacaccctccaagaacaaagcggcctagactttgaacccctccacgctaaccaaacctacctaaggcttatgccacccaacctccaattgcgtatccctcgcttgctaactcccgtaattaaatggcgggactcttggtggagacaaaagacccgtctttgcttcttttcttttccacccagcaagcctgcgggtttgggtagctgatacaatactccagctgccaacggccgttgagcgtgtcttatttcggcttgcaaactaacaggctgccttccttgtccaccagccgctcgatggacgccgttacttgcatgtctcacacgactaatcttagctgcgagcccaccgttccattttgacactgtctcacagccatagccagaaatgctcgtaccttgtccccttgtgtggagacacatgcccatcttctcaacacttgccgctcttcattttgtattaggtattagatattggggcgaccgcgtggtaaatcgttgcaatgagccaaagttgaagacatcttgcttctcttcacacgcccatctacgcaggtaattcatttatagctaccccaaattcctcgacgacgagttcgtaggatgtactctcagtccagtacagtaggtaccatttggtggcttgtccgctcctgttagtgaaccccaagtgcaggtacaatgtagtccacatcttcaactaggtatattcattgttgttgtcgcttgtgatcccttcaagtatatctgaaagctaggccaccgtatgtactgttggaagactgttcgttagagcatcgtcactcatccaacggctcatttcgagactggagaaagtcccagcacagaccaactcttgcttgcatcgtttccaccaacgtgtccacgtgcgacctggactccttgtcgtgcaagaacatcagcccgcttgtttcccttactatcaccatgagcctggaccttcttcagcgcaattccacgcttgacaagcctgtccatgatttttatacaatcctggatcaaatccacgttctccacaggcttgccctcactggttttccatccgtgcttcttccagtcatgtcgccacttggtgagacaattgatggcatacgaggagtcagacatgatctcgtaagagtgaccattgtcttttttctcaatcacttgatatgccttcattatggcctgcagctcagcccgttggctagtatgaaccgttcccataaccgaggcagcaacattccatgggttgttttctccgaaatacagaccatacccagcctttgcatctggaccaccattgttggaacacgctccatcgacaaacacctggtagactgtgttcccttgtttgttcacgtaggaaatgtcctcgctaaacgccttgtggttttgatcataaccggcttttcgcactttctcggtagcttcatcccaagacgcagctttcaccacacccttggacccaccgtagtacatcacggctgcctctcgggtgtcgaaaatgaaacaatccactatgtagaacgattgcttaggttcggcgctgtcccctcctttaatattgtctcgagccagttgtagagcttgcttgtgagacttgaccctatcctgtgcttcaaggagggccttggtcagagatttgacatcagcctgagccgaaagcagctcgttagtcgctgtctcaatgtcggtttcagcctcgggttttccttttgccttggtcttggcttttgctccggttttagtttcaggctggacaccagattgcgtcttatgattgacttgagattggaccgcagtcttggaccgatctttacttttggactgatctcgagttttgggctgatcctgaaacttgagctttgactgagtttgagactgatctcgagtcttggactgtgtcttagtcttggcctctggctgggacttggcctctggccgactcttggattggttttgagctttggtctgtaccttggtctgttccttcaccttggtctgttccttcaccttggtctgttctttcaccttgggttgagtctttagttgcttctgatgcttggattgtgtttcggattctgatttggtcgcatggaggtagtcggtagcatcctgaagcacattgaatcccttccagtcagaacgactgtaccctcggacttgtttttgagcgtccgcatagtcgtaaatacctggtttgtgcccagctctgaccgcgtagaactttttaggcatgtcgattcaaaggctgatagatttgacctggcgctttccgtatagtctcttccgagagtgctcgtactgtactcgtacttgtatttgtagctggtctaaatcaattaaaatttcagctcccaccctgcctctgcgcgttgcatccagcatgcgggacaggtcgcgtgtgtgcaatttggcgataataaagaactcgtcatattacgagtacgagtacgaatgcttgcacttgaaattaatggaatgatgcgacaaaaaaacaacaacagaagaagaagaaaaaatcctcagaaagatgatattacggtcagcccccggatttttaccatgatagatgcctcgagtagccagactgatgtgactgatcaatcacagcatcgagccatctacggccgcacttgtactcatttgatgatgatctgactatagcgatgggcatacttgacgtaaccgatatggtcctgatggtgcgagaaacaagtctgtaccatctgactccaaacgtatccccacctctgtcaaggccaactgttgacctaaacaaattcgaggacctcaattgaacggcaggtactctcatcctcgtccaatactgccgttattgatgtcccatcgctcgggaaagaactcctccgcgaagttcggggtctcggtgggtccaccagactgagtatgacacggttgtcctggtagtcgtccttttggctatctgttcgaaaatctatttctcctacgaagcagctaacgattaactgaaaccaaggggggctcatggattctacctggtatttgtgaatatatagtacattcaccgtggctacgttgccgagctagctcctcaccggtgctgagcttctggctcttactagccgcatgcattcatgaaaccgactcccttgggactgacggtttgtcttgataccgaacctgttggactatggcttccgatgatcgagagcagttactcgtaggaagtcgtcaaaaccctccccttctggttgattctttactgctgcgatccctggcctcttcgaagaatctgacatccgtcttaacaccttcccttgagcagtcagtcgatccgatctggcaagaggggcacatatttcatgccatctcacatgcatgcggggctcccaaattaatcaagtaaatcaatatacacaaaggtgagccgcacgatgattgctcggctcttcgatatcacatacttatatccaccgcgttccccaatataaacagcttatgcatgcacatcactggtcaaaatatgtccggcagtataagctggggggagcccataagccggaatgttttccctcgcataatcctcactgttttcaaagtgacattcgagagtcaggaattgctatcatacgtcgaagttgctgaaacacatgctggtctttcatgacaaacccatccacgtttttccacccgttcttcttccgagtgtaggccacttgagtgaggtgaacgcataggctggatctgaacagatcccataagaccgatcgtttcccccccttgaaagcaagctgacaataggcccttcttatagcttccagctctgctctctagttgatgtcaattggtgggcagcaggcttccggaatgttgaaaggattgtttctgccaatgtacgccgatatcacattgagagccttttacaagagcaatcggtaaacacctggtatatcctctttccgtcacacacatccacgtagctcaagtcctctcaagacagctctttctacgtttgaagctatccctggctagccgttgcccttgcatgctggagatttgcgcatactgcaatgctgctacctatggcatgttctcctgtaattgacagctccttaataacagtgttatcaacaacaaagtgcatcttggagtgtgtcgacggattatcatcagtctggtcatcaaaatatggtgccagcctttgcatttctgtcttataaagggctagagtttcggccgcaaaggcttggaagaggaagctccattttgcaaagcgctgtctttctctccgcgcgtcagcagttgcctcctgtagtgatttggttgacacttcgatcttggccatggtgctggttacagtctcttcagactccaggaagtgacataatgttcggccgcatgccattgctggcgggggtccagctcggggcacagtttgaatgtggtttggacttgttccgagactgtgatttggctggcgattgggctttcttcaggtgattaagagcgtctttcatatgttgaacccattccaatccgaatggctgtagccctggacccgttgctcggtcacttcgaaagagtacacatccggtaagaatgctgctttgactgcgtagttttcttttttttcgacatgctgaagttaatgagatgttttgtttctcgtgatcacaactgcttatcgtaatgcgtcagtctctactgtagagtttcaacgcgtcacgtatttttcatgcagtaaaattagtccttctcaagaacatcagcgggatcaacttcacatcacaacaacacccaagacacaaagacacacacaatgcaatctttctttgcaaagtcgcaacaggcgcaaaaggcagacggcaagaagacgtcgaaaaacaaagcccctcctccatgggttgaaaagtaccgtccaaagtcgctggatgacgtctcgtcacaggatcatgccgtgactgttctcaaacgaactctcggctcagccaatttgccacacatgctattctacggccctcccggaactggaaaaacgtcgaccgtgctcgccctggccaaagagctgtacggacctgaactcatgaaggatcgagtgctggagctcaacgcgtcggacgaacgaggaatcgccatcgtgcgagacagcatcaagaattttgcggcgcagaaggtggttgcacccaaagaccatattgccgaaaagtacccctgtccgccattcaagatcatcatcctggatgaggcagactccatgactacagacgcccagagtgctctgcgacgaactatggagacgtactcggcccagacccggttctgcctcatctgtaactatgtgacccgaatcatcgacccgctagcgtctcgatgctccaagttccgatttagactgctggacggaaacgacgccctggcccgtctgcggcacgtgtctgacgctgaacagctctccgtggaggacggagtgctggagaagatcctggaggtggctaacggagatttgcgtcgagccattaccattctgcagtcatgttcgcgtctcagcggagagtcttcagctgctcaaaacgacgaagatggagacgcaaccatggctgaaactaggcccatcactattgccgatgtgaacgagactgctggcgttatccccacagagactctcaaggccatcatcaaggcatgcaaagactccaagggacccattggagacactgtgcccgacattctcgtcgctgtcaaggaactgacctactctggatggagcagtgctcaaatcacctcgcaaatgcatgacctgattatcaccgacgtgttgattgaaggtaaggaaaagagcaagattgccgagctgctgtctgtcaccgacaagcgtctggctgatggagccgacgagtctctggctatgctgaatctgattgtgggtattgctgacgttctaggagcagcaaagtaagcactatgcatgatatatatagggagagggggagtaagtatgtaacgtttgaatgacattcgatttttgattgtagacgtgtgcactctgtttgtgttaaatggttacatgctatgaatgctgtctggggtacccgtacatactgtacatactggtggagcgtcctccgtagtatcattatcattcttatatacaattaaaactcgtaatcctgagtgaataccggccatttatcaatttccatcagatggcgcatagtgggtcttccatggggacagttccagggcttatctagacctgcgaggttcctcacaatgcgatccatctccttttccttgagagcagtgcccaccatgacacttcctcgacaggctcgagacgcaaacacgtctctgaccttcttgggacgaacagagtcgtttccggggttatcttcgaacaggaccacgagttctcggaaatctggcattccaaacacaatgtttcctgtttgagggaagcctcgaatttggcacttttcgccaggagggagagagttgtcaatggtcacgagaaagccgttcttcttcaagagctcgagattgctactgacaacagattcttcaagaggcgtcagttccaccgtcagaggattcacgaatggctgaggagtgattttagtgtctctttgaagtcgctcaaagttgtacttttcgtcactcgcatgctggtcaatgatgaataggttctcggggtcagaaacaataatgaatgcctcgttgaactggccaatgatgttaaaattgaggaagtcattcctggaaatggtcaggttgagcttagattcagctgacgaatcgtctagagcagacgtctgcggttgagaagtgctagaagaagtgttgaacgtagagagagtctcagaagcccgttcgcctcgttcaagatcctcggccgtgattgtgagagactctctatgtccaaatgtatcaaactcaggcaggttggcataagttcgctttctggaagaggctcgttgagatgcaggaagagatggtaatgatgatgcagtggagggccgagtggaagaagacgacgagggtcgcgaagaagcagagaactgggataagttgagtttgttcacattgctcttggtcactcgtcttcggctggtgattggggtagttagcgagatggaggtgtcggatacagagttcatagaagtgtccgactgagagtacgacagtgagctagttggatcgttgtcgttgtcgtcgtcgtcgtcgtcgttggtttcatcatcattccctctgtcttctccttcatcctctaaggtagcagctgtgtcgatgtaggcatactctggaggaattttttcggggtcttcttcttctgcctggccttcttcttcctcttcttcctcctcttcctcttcaacttcctcagcctcgtcatcaaccataccttcatcctcctgctcccgtggatgatcagcttcatcagtagtcatatcattgattaccagcgactccgtctcctcaacgtaagtcatggaaacatcttcctcttgctcctgatcagtaacaaacagtccagccctctcgatctgaccagcagcggcctgccttacttcgagctggtttggaacatcgtcggaagtggcagcttcatcaagttgaacattatgatccagctcaacaggtcctacctctccagattcttcaacgtcctcaacttcctcaatctcttgctcaccaacatcgtccttcacgccccaatacgactgactgctcatgggctgcacctttacgtcaacagtgtgccgaggaacagattgaccagaagattcaaagacatcaacgagattttctcgaatacaattgatcacgtccacctcattatgcagcataatggtccgtttatcaggagaaacattaacatcataagcactaggaggaatgtccaagttgatgatcaagacaggcttttgtaaatgaacgaacgacgtataaacgtcttgaaacaccttctgtagcttcttcattgtaaagggacgcttgttgataaaaagtaactgtttatcgttggcattacgtcccataccaaacacaggcttggaaacaagtcccgtaactcgaacgacataattgggcagctcttcagaactaagaaagccgcgtttcgtgtaattaacatcgaaagaaaagttcacatccatcaaatgagccttgagctcgtttccaaacactcttccaacagtctttatcatgtcccctgatccgtcggtggtcagctgcacgtttcggttcttgttgttggtgacatgaacgatactaaaccgcacatctgagcgtataatggcgtacgtctccagcatgcgaatgagccccgggtgactgttcttggcgttcttctcgaactctttccgacgaacaatggcactgtggaacagccgcctgatagtcacagttgtacctcgtttaccagccacaggttttgtgctcttgatagatccgtcacggttgaactccagacgtgtggcgggttcactggtgttgccacatgtgacgatctcgagctctgccatctcacagatagatgccagggcttctcctctaaatccataactgagaacgctggccaggtcgtcgaactcgatgattttcgacgtcatgtgcttgcgtgccacgtggtcaaattcggacttggggattccgtctccatcatcaatgatctccacacgatcttttccatagtcgaagattttgatttcaacgttcttggcgttggcgtccagagagttctccacgacctctttgacggcggaattgaggtccgtaacgacttgcgccgatgttatctgtcgaattgacgcggtgtctatcgccttgatagccatggcggtgatagacaggtgttgtgttgtgttgtcgtgtagcgtacgcgttgcaattaagctgcttgagtgaacaaggttgagagaggtggtaatacgggggttgtggaccggttgtagacgggtggttgaagcgctgtttcgggaaatctacctatgatggaagaagctgctctctgccaaacatcctgctctccggctatcgtgctaggggtgtttgagtgtggtctgtatactatgctatactacgcgaagttgttaggatgagaaatcccgaaccttatttagttatctttttacattagctatagttgggagtgaataaaataacgtccattttccaagtataggtcaaaccagtcaactaacactcccatctgaactgcttaccagaaccacctcacaaaagctcagataacgactatgaccaaagttgcctccgaagaaaactgttgatatctgcctgacttacttgaattgtcgccacaaagacaccccttctctgacgtttgccacccaccacacgcagcgacagcagaaagcttgcttctttctccacacatgaaagcacaggaaccagataccactacgtatgctgccgtgttggagagcatccggacgtttctagccgtattcatccacaacattgcctattacttcaatgtataccccgcagacgcttttcaacaggtgcgtcagttcaactccgcggtgtggctctgtcgagcaccagtagtcaatggatacattgacgaggcgagccacgagtgcgtaaacctgctcaaggacggtaaatgcgccgccgtggcaatatcgattcacaactcggcttccaaacacgttgctacgataccaatcaagttcaacattcctgttgtaccggagtctgaccaaacagtgccagtgaccgacgctcccacactgatcgaggacctccaactcgaattcaacgcgttcttcacacgtctggctaactacgggccaaatttcaacccttccaagttggaacatacgttcaagatccaatgtgagctggaaggacgccatactctggagggctggatatcatcagaggctcaaagtagcaaacaagtcccaggattggaagatgtcgtggtcagaaagatcgaaacaggacccatagaggttgtttcttggttggaatatgtgtaactgggctactggtgatataatcggccatttcaccgatgatagtcgaccacttcaccgatgatgatccttacaacagtcggtcacaaggggactcgtcatatacattatgcgtccatattgcaatctaatatttttattcgtacaccctcagtccattcctacaagtacttgttctatgctctattatattcaacatgcgttatgttatgcttctactataggtccggtgctgtacatgagcaatgatggttactccagcattactccaaccccaacatggtcttggtattctcgtagaccaaataacttatactgacggcaggagccaccttggcaaggttgggagccagacctctaaacagaccccggtaaccgtccttggtcaccgccttgtggtatgcatccatgatgccagtgtacgtctgaggatgagcagcagttccctgggcctggagacgggttcgcagcaggttgatggggtacacaaccgtggctccgacggaaccggataatgcgcccatggtcagaacggccatgttaccaatcttgacgtcagagttctcgcagcccagtcgctttgcctctcgggtaatgtatcctcgcttcatgacctcaaatgttcctagatcaagcgcggcataagggaaaatgcctcccagaccagcccacagacccctgtagtaggtggccagacctccgtttctccacatctgcttcattgtgtgccacagaagcgcattgccctgaagagcgccggtggggggctcgcactggattcggaacttgagcgtatcgatggggtagaccacaaactgcgacacgacacctccgatacctccggccagaaaagttgatgcacgggacaagtcagcagtgtcctccactccctccagctggcacagaaactttttggcggtctcgaacgagccaaacttcatggccgactcgggaatcaccttgaacacgttgagaccgttaccaatgaagaacgaccggattcctccctcggcccaaatgttcttgatggcattgatcagcacgtggtgtcgggccatgaaccccgacgggggctttgccttggatgcgttcttggcaatgctctcatagacggcctccgaggctcctgaagcagcggctgtggttgcgggagtgataggatcggcaatcaggtagaccttgagccgatccagaggagcggtggctgttcgggagatggctccggcaagaccgccagccagaaagtaccccagaccttgtaatacgtctctgtgaaaaatcacgtctccttcggagctgagatccagctcctctacaaaaaatttgtaggcggccttgagggtagagccggcctcatttgggaccagcagcaggaagtcgcgccactcgtcgaaacaaatgtatccgtccttgtctcgatcgagggccttgaagaagtcgtctatcgtgtcgctgtccatgtctcccagtcccacagctgccattccgtcggccagctcctctctatccagcttaccgtctcccttgtcgtcgatgatgtggaacaggtagaccaggttctgttccgtgagctccaggtacgactggaactcggacaggtccacgagaccgtcctcatttgtgtccataagattcaccaggttgcccaccagcgagtctgcgtttcgcagcgtgtgcgactcgggcacagatccaccgagcgagccactgaaggctgccacaaagtcctccttggacagttggcccttgccctctcgatccagtttgcggaacatgcgttcatagcgtgcgctccgttgttccggggtttctccggtcgaaagcgccagctgctgttgtttttccgccttgagaagctgtgcctgggcctgctcggcgctcttgtgtgtgtgttcggcggcttttgtcggctccgtcattgtgtggtgtctgtagaatgtaggtgtgttttttttttgtgagtggttggttccgattctgcccgaaaaattcacgtgttcctaggtcacgtgggctctatgcgtgtaaagcgggggatgtggtattcgccttgttcgcctcggtctcgtgcctcttgcttcctggtcgctggtagcgttgcttcttgaggcctggtggagtattagtgtaggtggtgatgcaaagaaaattcaaaaaaagaagtcaaatgcaaaccatgttatgtaagtggttggtggggtgaaaggggcccaaaggggagcaaatatacaattaaaaacatgaaaatcatatcttgaccctgtatcccttcgaatagatcacgtgacatgtcgccaaaccgtccctatcatcgcgttgtatggaacatcaactccccccctcatcgacagacacaccctatacagaatagacactgtatgattgggttgcgaatagaagggaccttccaatgaatgactaccagtacatctacgtacgagtagacatggggcctgccaaaggtgggtcacatgacctcgagttgcgcgattggagcaatcgataaatttgagagaagtcggctctatacctccactcttgctacatcccgcgcaccccacagtagagtctgactggcatgtttgctcggtacacatgattttaacctcttcaatatatatactcgggctagcgtcggagtctaacgtctggggttttgaggtgtgtttctgagtctgacaaggcagctggtaaggatttttgtgtttgctggatcgggtgttggtggtcatagggcagttattgtgctctatcaggtcaatttcacccttggtggtgctctgttccccctcagtgggcaatgtgttcacgcatcttgaccctacattcaccgctttctcctgccacctttttctccacatcgaagtccaccgccaaatgcacgtcatgcttatttggttcggaattgatttcctttttgagaggcctgcaaatggtctcgatggagtatcttagcgagatgagacgccggctcagatagatacccgccgacactgcgcaatttcgctcttcacagagagagctgccgttagcagtagttgttggttgtatctcactagcaagaacgtgattgttgatgcgtaggcctctttcgaaatagagatcgtacagtagctactttgtagccaacagacaacagagatagacagatagcttatctggcgtgttgacaggtcacgtggcaaaaggcagtcccggtcacgtgctcttatttcacacgcagggtgtattttattgattttgatagccgtctgctgtccttccgcaatcacatgatgcgccaacgcttttctgtagtccagtaatcgcttggtcctggatggtgttcataaatgcactatggtgagcttatttctgcggttgatgactcgggccatcctgtgtgtcttgtggttgtgtgttcgaagccgagcggggttcctttgtggtgtatttgtggggtttgatggtttgattctagagcttttgagggagctccatgtcaattgacttggaaacgagtacaggtgctcaaatacgactttctctggtacacatgccttcattactccaatcttggacaatatcggacctagaacctgattgggaaaagatacaagagatttgaatatatcccagtgaatctcatgtcacgagctatccgctggtataatcacatctggaataatgcgtcatctacccccatttcaagtcatcggatatcacctctaacttgccctaccattcatcctcccaaactctgataatgcatacagcacagcacatcaccaaatcccactcacctgcaaataactcacgagcagcacacaccacacatcacacaccatgtcgcagattgatttccgaagaattgacgtcgaccagtacgacccagactcgttcatctctaaggaggatctcactcctccctgcaagcccgtctctgccgctgagcagcaacaggtggccacggaaatccgaggagccatttctcgaggagaggccaaggctgcccttcccattgcgctggactttgctccttacggtggtgatgacaaggtaaaggtgagtatggagcggtggaaacgattgctcttggcagcaagtgaaacccccatcagctcgtgatcaaccgacatctggggacacaatcagttgtcttttaaatgtaacaaccgccagaccccacgtactaacccaggacgcccacctcaagtctgtaattgaggttctgagcgcaaccaaatcggccgagatcccatccgtggtcaaggctctcaacaaggaacagcaggatgtgctcatcaagtacctgtacaaggccatgggctcgccacagggccagtcccagggagtcggcgccatcctacttgcctggtacgagaagaccgtggacatcaccggacagggagccgtcgttcgatacatgtctgatcgacgaactgtttaagcgagtttaagcgactacaagcccctcgaacagcggatggatgtgggtaaatattatgaggttctctcgcaattgtaaactacaagcgttgcagatcaatcatataacggtagcagtgctaatgatgtaaatgaatgtaaactatcatctttgtttggacaaaatcaagtgtagactgcaagtcagtgttcttgtgtagagcctatcgaagagctgcttcagtctatgtcgtccattggccagtaccaacggtgaataatgtgtgagttcacttgtcatagacacagtggatctgccaactatcaatattgttaatgtatggaccttcacgttccctccacgacatggcatcgtctaagatgatgccccttgggttgacattgtcttcttacatatgatcatccaattgactagtaaaaactgtaggtgggtatgagatcaactgttaggaccactttccatctaccacttgaatgatatcatgattatttatgtaattattagtaatgtctgttctcttgattagtctgaacgaaagctgtctggaccatgtgcaatctcaacgttctctttgtcaacgttgagtctctgcttaagtaactgattttccttgcggagctttaccagctcgtcgctgacattgtcgctgttgactcgtcgtcccagaatggagatcttcttgtctgtgaagttctgagcagcatcggtagcctggtctagctggtccagataccactggcgcatctgctccatgtgggtttccatttcctggttgacctcttctcggatctggatctccagggcgtcttctcgctgctgagcctggtacagttgctcctgcagagcagcgatggttcgaatgagattgtccttggtgtcatcgtgcgaagtatgtgatgcggaggacatatgcgacatggtggagcctgtagaggagatggatgagttggaaaccgcgcgttgagcgggagtggaaggtccagaaccagctcgcttgaggtaggcaggagtgacgggtggtttgatggtatctcgtgccagagcagagtatcgcatgatctggatggtggatgaaaagtcggcgttctggttcgctgtgataaggagagcagtcatggcatctctggagaaggcaactggaagaagaagttgggcgagcttcgaagatcgaagaatggatcgatccaacttgtatcccttgacttctctctgtcgctgaagacactgtccgagcatcatgagcgactggttgatggagcaggcttcactgagacgttctccctcggcccgagtgctcttgtttcgctcacttccagcaagatcaccgattgtaaggcttgtggtgagcattgttcgacccagtctctttacggtgactgtgaaaagagcgtgggaccgcgaagacacgctgttggactctgtggagtgggtgcttcgtagtgcatgggcctgttccagcacttggaaagcctcctggatggttgcgcagaagagtttagtctgcgagggaataccaaacttgccctttgtgtcgcacttgaccaccacgggtcggcgtttgtccagaagatcaaaaactctgtcgttgtaaatctccaccatggagatgtacactccatgggaagatctctggccgacagaagagtacaggtcagcgttttcggcaacaacggcgttctcaatgaactggttgagctgatgttggctctgtgtaagaatgccgttgtcaatgaaaggaatggcttccagaacatgggactctctgttgggacctgcgcttttttcggcaaccgcttcagcctcgtcaaatagacacaggcggtcaccaatggcatcaaaaacagacttgagtgcataatgcaccatgccaggacgtcccagccgagggttaccaagcagagtgtgtgtcttacctgacccggtagttcccatggcaaacaacagaccgtctcccgatcctgtcaccacattttttaccatgggcagcatgacctttttgtaaacctcctcctgagtcgagccgtcaaagacctccgaaaatgcaaacttctctttggtcctggttcggctcttctctggaggattggtgatgatggtggaagggtcgtccgaggcgatttcgagatacggcttgtcagtggcggagctgggccgcgagctgggctgctcgtcatccttgcgcagtcgcaaatataccggtagagacatttttgaagctgtggtgatcgttctgttacagcaatagggtgtttaggtctagccttgggtatacagttaggggtctatatttgggtggttttgaattacccttttggatggaggatggttgtcccagcaacggctcaacggaaattatgggggtggatgaatgatgaatttgtggtctgtcaagggagaaacaatttgaaaagtatccagaagtgatatccattagattatttggctcatctactttattatgtgttataaatggtctgttatggtgttgatgtttgttaagaagagatacttacgaaactttactgagacgagaaacagtcaagctgaagtgctttcaaaagtgatatgggttgtttttttttcacttcagaagtattttccattacagaaaaaacagtcggatgtttttattaataaaatcttttgttttcgggttagtttagctgattctgtaacagatctcaatgggctctacgatgacgattttacttagctttagttaagatttttaaagaaagactccagaccatccaagtatgtggtactggagtagtaaacacaagatctgggtattcgtgatttggattgataaatcgaggagcttcactttttcttcttttgttgttacgtcccttataagatatctctagagatctctatcgatcgttcttctcttccattcacggagttcctgtatgtaatgtacatagctgtggatagcttcgagtgtgtctaaaacactgtgttgcgattatttaatagaatatcgaagattgaaaaggtaatattacatgctatcgcatttcattcactttttccttttgtcattctgctcattccccatccagataacagcaccttcctcttcttgcgacttgccagttacccggagtgcttacataatcccagacgcaagccgcccacaatgcagttgcagaaccacaccaaataatttgtgttgaatactgcactacgatacacacacaattcgatcccgaccatgtccaaacgaacgcgagaagagcgagagtccattgcgacccctcagaaaattgatatcaagcgtcgcaagagtgaggaggatgttgttgatgccgctgaggtggagactacacccaccaagcctgtgaccggcatcaagtggactcccagtgaggaggatgtggctgatgccgttgccgaggctgctgaggagaccaaggcgattgccgccgagacccaggtggttgctgatgagatcaaggcggctgagaaggaggtcgaggagctcaaggaagaggtgaaggctgatgaaaacgataccaagcaggagtctaaggaggttgggaaggaggctggtgatgctggatccaagcaggagtctaatgctgataataacactgagactaaggctgatgagaccaccgggactaaggctgatgagaccattgagactaaggctggtgagacggctgagactgtgactgagtctgctactgagaccaagctggccaaggcagcagagaccaagacagaatcatctgcacccgaaactaaggacacaaacggcgactcgaagccaaagcacgtgtttggaaccaattccaagttttcgggcggattcggagccttcaagggcggatctttgtggggcaagcctgcttcaaccaccacctcttctattaccacccctgcatctcctgctcctgcagctgcttctacaggctcttccggctatgtgtttggctcggccaccaagtactctgggggcttttcctcggtgctaaacaacctgaagaaggacgataccaagtctgacaacccatgggccgagaagaagaaggaggacaagaccgaggacaagaagacagataaggatggtgaggacaagaacgacaaggacaaggatgcggacgataaggaaaaggaaaaggagcaagagctagaaaaggaaaaggaggctgaacattacattggtgtcagtgccccgttggccaaaaaggagtctatggagaccggagaggaaggagaagagtcgatctacacatgtagagccaagttgtactacttcgacctgaccaataccactgagggatggaaggaacgaggagttggtcaggtccacatcaacaagctcaaaccagaagacgtgaccgagacatgcagcggccgcatcgtgatgcgaacagacgccgttcatcgagtggtgcttaacatgggtctggttaagggtctggaggtccaggcaggtatgggagcctctctgtccagtgacaaggtggttcgtatttccaccattgaggacaataagccggtccagtatgcgctcaagaccggtaatcccgatgccgccaagcagttgttggcaggcatcaagggtctcatccctgtttaacgaataatgatatagtgtaatattagagtgttatttcgtgtattgtaggaagatgtggtacgagacctggtttgaaatgacgtactcgtagattttatatcagctgctgtttactttcctttgtcccaggatctactccttcttgaatgcaatggtgcacacggtggatccgtcggtgcctccgaaccggaaagaagggtatttgacatgcttccactccttgagacaggtgtctgtagtcatgatcttgacgagctcgtccgaagtgaagttgcagctggtgataagaacaacacccctagtcttgaccatatgctgaacgacatgggggtatgtttgcacgccagtcttgccctcatacttaatatcagacagggcaatggcgtccaaagtacccttgtccagcacaacgtcccattgtcggttgccagtcgaccacatagcggcatctcccagaaaatccgcatgctcaaaagtaatgttttccatctcttcctgctcggcaatcttggtggagaactccacagcaggctgagagtagtccagcccagtcaagtgaccagtgaatcccccctctcggatactaaacagcagtcgtccatttcctgtgcccagatcgcacattttacagtccaaggaaatcagagactcgccctggccctgctcttcctcgtcaacaaggaagtccaccatcttctcttctgctccagagtcactgaaccaacattctccagaatcgttggggttttcggcgtagttgttcttctcgaggttgtaaaattcgtcccagtactgtttggtaccgagcttggacgaggtgagctgctcaacgtcagacatggattgtggtttttgtagttcaagacgatctcaaacttctccgatattgaaatttcatgcatctccgaactttgattgaatctactctgacggttttcatatactaatagcggattggtaatattacgaatgtaagactggttcattttgatttctaccacagttaacaaggggaaaaaatgaaaagaatcttcaaaaaacaaaaaacatattgcaggaatcaaacctgcttgtttggaacagcatgatgctgccatcacccagaatcgaactgaggtttccacggccacaacgtggtgtactaaccactatactatgatggcttaataaaagctttagtggagctaatttttgtgctacattatccaaaatctgaatcagggttagggcgaaaatgaaacttcaaaatgtagccctctaaaaagtggttccatatttcgcctacaaaacatgtctgatccagatcagagctggagcaaaaagaataggcacttgccatcacccagaatcgaactgaggtttccacggccacaacgtggtgtactaaccactatactatgatggctggttgtgtgaccgaggctcactaggtttgatttgggcgccaaaacaacttctgtaattgggaatatattttggtctacgaggacaagtataacagccagaagaacagaaatatccgtcagaagtgtttgatatgcaatttgtttgacgacatttaatgtggtgttttttgaggccatttactgcgcagctctttcataagtgtggataatactgtagtaatgggaaagatattaagaggctgatatactagggtgagtggagccagcagtcttcgtccgtatcataccttttccctagaagcaagtgttgaacttcctccggcatatcttttccatgctctattacttacattaccatcagttgactacagtatgtgcatactagtattaccatctcatctgaataatacagctatatatttacatgccgtgtataccttcagcctaataatactttgtaggctctcgtcctcctctgtctcctcctctgtcagctggccctcttctgaagtcccctctatctctttctcttcgaggaggacttctgtctctgtattgaggtcgtcgttctcgatcccggtcacgagggtctcgttctcggtctcgatcacgtggatctcgatctcggggatccctgtctctgaaatctcgtcctcctcgacctccgccccgtcctctgaacgagtctctgtagtcttccggaggtctggatcctctagggtctcttgatctgggcccacctcggtctctgtgtcctggaaacagatcccgtcctccagctcctcccggtggcattggtggaccgagcggtttgcgttcagactcctttgtgtagtgtcttccgccttttcctcctcctagtcgtcgaggaagccatccactgaccgtacggcctctctcgacgtcaaccaccacttttctgcccttgatgatcgatccgttggtcatctgaaatgcttttcgaaaatcgtcttcctcctggaattcgacaaacccatatccgttgctcttgccgctctttagatcccgtacaatacgtacgtgtttgacaggcccaaacttgatgtaatgttcctccaggtcgttttcagtcacgtcgaacgccagacgcgccacaaatagcgtcttgaacggatcgcccacaatcttgtcgtccttcttgggatcccatgcctcttttcgttcctgctgggtcaccttttggcgctcactttttagccgcttctctcgctgctgtttgaccagccacgactcggtcggcacgtattccgaatcgggctgcttcaacagctccatatacgccgaaacgcctgagattttctgcgttcttcggtcctcaggagcatagtcgatcggctccaggtaccgtggctcgggacactcggggaagagccgctggatgtgagggggtagccgttccagttcagcctgggttagccttgttgttgattgcagagcaaatgtcgcgcagatactcaccatgattatggatgctgttagtgtgtgtagtgatgttgatggtcgtgatgttggtttgaaatattagtgttgtgcatcagaagtttatctgacatcgtgagtagggtgaagtgagatggcattgaagagagttatacaagaaaggtagagaagaagtaaatacaaggggaaagcgaacagaatatcgtcactagtttgtttttctaggttttatttggatatattcttctgaagaagacttttcaagacgtgatcgagtttttcagacccacagtgtgccccaggaagaatcagcgagctacaaggctgtttgcaataacaagtacactgtacttgtactatactgaccatccgctcatactaccgtctccaccctccccttgatacacaaataaatactttactatatacattgctgctcttttgtcccttctaatcacaggtcaggaggaaagagagcagcagcaacaagaccgggacgctcggtggccagaagatcaaagttcttggctccgttggcactgtcagagatctcgacggagattcccagagagttgagatagtttcgggtcttgggcgacagcactcgcgacttctttcccaggccgaagatgagcagctcaggacgagggtagacaacctcaaagacacccagtgcagcaggatcgatttcaaccagaccggtatcgagacccttgacgcactcgggagtaaggttccaggccagcacctcagaaaggcccatcagaatggctccaacgggcttctttccgctgggagacttgctcttgagcaccttgtcgtccttgaacacaaagccgttggaaagcacggcctccacgttgttgtgggccgtctcaagatcgccgtagagatcgtattcggccagagctcctccaggacgagcagccgtgttttcgagctttcgcttggttcgctccatgggtccctcgcccttgaaccacgggttttcgagcttgacgtttttcgcacacacccgagaggtgtggatcgagcgggacaagattccgacggctcgtgttcgcagcattgtttttgtcgtgagagcgagtgagttgtggtgttcaagacgacttcagcttggtcttgattcgctctgcattggaaccttgttgatgacttcagtggcggtagtcgaaagaggcgggagaaggctaagtaaacgtttgacaattagctaactaataaatgccccaacattagtaactgtatttggcttagttgaactctgaagggcagatcaataccccctcaagctcttctaatattggtaattattgtatggaagaatccacactgtctccattgttgtttttcttccatttaaaatgctctccttcatattaattgtctctcattaccaagaattactcctccccccccttcgggcctccacagttaccctacctttgcaaaattacaggagcctaaacgcaacgcacagatcaatctgaaatatctacattcaacacacaaaaatgtcggctcgaccagcttaccagactgttgcccgaaacctcaacggtgtcggcaactttgtgcttcagtgcaagaaggtcactttccggtactgcaactggggtggctcttccgacggaatgaggtgagtatcacaacggggaactgaactgtgacttggacacggacatagatggaggtacagacatgccagtggcacaagtggggtgctagatgaagagcagaatgctacccagtgcgtgtggtgtgacgtgtcatctttgtttggtctttgaattcagacatccaccgcgtctcagatcacactaacacagacaatacctggacaagaacctgcagaagattgctgctcagaaccccgagatcgagtttgtggctgtcaaggacattggccaccccttcatccgaggcgagtttgtcaacggtgccgagaagaccatctgctgcaagaacaagcatccccgattcatcaacggcaagtttgagatgctcaagagctccgacggagctccccgaaagcagatgaagagccccgttgaaagtataaacgagagtgtccgaggtatctggtctccttaccataccgaccccaaggcacgacacaagatttaaatgtacatagtaaattatagcatagcgaaagatggtgaaagagcgaaggacaatggccgatacgaatcgccatagtagaggtatggagcgaatggtggtgtgcaagtggcttttataccataacagttgtgacacagtagaagctcgtttgttgaattatgcggcactccgacgatctctaactacgatatatcgtggagcgcaagtgagaagtacttgtacgaggcaaacaagcggttgtactacaagtgttcgtacgagtacagtactcataagtacagaacttgtaccaacttgtatgaagtcactcaattactatagggatgaacagaaacacaactactggaagcaaaagggagtgaaaggaaacagaaacagaaacagaaacagaaacagaaacagaaacagaaacagaaacagaaacagaaacagaaacagaaacagaaacagaaacagaaacaaaaacggaaacagaagcaacctgaatgttgtcaaaaggatacttgtagtagattcagcaaggtgcaaggtaacatcaacctcggctacagtaaacttgggaaattgattgaagctgtgtacatcacacagtctggaataacttatttctatgcgtgcctttcctccgtctattttacatgcccaaagtggctgctctcttgtatcttatgctttgtgttgggggtcgagctggtctatgtcagcctctctatcatgacagaagggatgctcgagtgcctgttctggggtcattcgcttttcggggttgagtgcaaagagcttgtctaatagatcgatcagatggccctgtaggatgatatctgatccggtctctctgcatttgcccagcagctttttgacaggcagaggagcctggttttgtgtgtatcgtagtgtatgtgtgatcattcgtccagtatgggggtccacttcgtcggacttgaagtcgaggttctcgtcaaagtacttttccgtcagcttgccttttttaagctgcttgtggctaaacttgcctcgcacgtccatgatacacttgatcatgtggttgttggacgagcctgcaaacagaatacatccggtgtacagctcgtagagagtgcatccagcggaccacatgtcgactccgtagtcaaagggcgcgcccagaatgagctcgggggcccggtagaaccgcgatgcaaggtacggcatgggttccgtccacgccttttggtccttgttggcctccacggccgaaccaaagtcacacaggcgagtggacgaccgtttggcgttgaccagcacattatctggcttgaagtcgccatgcaagatttggcattcacgcagaatttgcagactagtgaaaatttgccgagcgtagagacggacggcccggatgttgatgccctggttgcgtccaaactccttgagaatgtctcgaagattggaatgcatgccttcaaataccagacacagatggcccttgtggtcgaagcggtcgatgaggccaataatcgagctcgtggactggtgtttgttgaggcggtcgatgattttgccttctctgtctccgattttgcgcatggcgtcgttacttcggatgattttcacggccaggccgtcgttttcgtggccatttgagctgccattcttgtcttctttttcgtttccttctttccccacctcctccaccttgacaacggtagcactgactcccttgcccagatgatccaccaccttgtacttgtcgttcagcacctcgccaatgatggtcttgtagtagttttcctcgtcgtcccatttgtcgagcagcttctggtcgagcttttggcctttgcgggccggcttgtcggcctccgtcttttgtcgctttttgtttgggctgtctgtatcagaggccaggtcgaacatgtcgtccgagtcgtccgagtccatggggttcgctattttcgagggtgtcggctggacgcgtttgagcggggcggttgaggtcgccatttgggtctgtgtgtcgagattcagcagcgaggggccggcagcgtcgtttttatcaaattgctccacttgctattatgcggtcaagcgtgcagtagtgtggattaggtgcgtatgatttaagcaaggttttgcggtgatgatggtgggtgttgattaggggttgcgcgagagagagaaacaggagatatgcacgtgattgttggccaggagacatacgatccgattccgcgggcctccggcaacgccacgccccttgcagcctcagatacacaccgctctgcttcacttgtgcttttttgctagcccaactctaacttcagcaaccatctgatgttcaactaatggctcggatggggggatacaacaagggttctttatatgggtggatgcgtggatgactcgatgcgtcaatccataggttggttcggccctacctctgcctcccacactcgcaatcgcgtcctcacaactctcaaaacaaactcctgtcatggagctgtcaactctaccattaggctgcctggaaagatgctcaggtccgactttgaagccccagaggtgacgtgtgacagctgtcgtcggtcgttgcaagtccctgtcggactttggagtagcttaaacgagttccgtggtggttcacccagcaatcggcgttgttgttgtccctcaaagcacggcacgtcgccaaacctaccgtttcgctagcctggctcattgcagaaatctgccactagtggaaccaagaatccagacagcaacggtgtgagtgcaacgtgcaggtgtgcagtgggtgtgtcacgtgagtgctgcggcctgtggattttagcgccggcgtttggtcttccatgttttcccccaccgtattcatccgtgacacctcgttgcagctcgtctatacgtgttcgtgttttccgtttgtttttcgcttcttttttttttcttttttttcttgacactgcggggccaagtgtccgattaggctcggccagtgctaaccgaaatgaaaaaagcaacgatattccgagccgcaactgagacagtgagacaacgagcaacgagcaaagatgccacgtgaaggggtcggcggtggcaagaacggtggtggtgtggcaggtttgcagcgtccacgtgatgagccactatattgttccatgactccaactcacaccaagcccaccatcccgaggtgtcaggaccagcagggccgatatgtgcatctgcagttcctgcttcaacttcagcgtgtcagaccagaagaagacaagatggaggagcctggaacagagctcgcttataaccactgctttcgttgggtgcatttgagaaaccccgcgccttgtcaataccatacgactaccgtacgtactggctggtaatctcctggcacccactccactcccccagcgagccgagcgctccgtgaagacttgcctgccacctcgggccatggcacaccagaccgggtgatatgcacaaagttcggttagcctgtcgtgatcaaataagctgcgaatgtagaagtggaccagtgattcttgtccagctagcacaacggattccgagccgctagcgcaaacctcaaagcttccgtcctcataccggctcaaaaagggatatattgatgaaacacaaagctgttggccttagtcatggtttgtgatgatgggggagatataccacgatagacctacaaggctctgagtgctattgtagaagtcgcaagagcgaagagttgaaaatgggtgtggaaaagactgctcgagtggattagttgcttttggagacctcttacaagtggtcttggtctgaggttgctttgtatggtggtgtccagagcttcagtgtttgttgcaacacacgagaaatacatagtggctgtatacaccgatgataaaaaggcatctgcaacagacaaagctatactacgagtacgagtacttgtatcctgtatattgaccatcagcaagcaccatcggcgacatcccacaaacgatttcaggcactgttatgcattcatgacagcccaactcatcgacggcattcaacagggccataggctcactgcggacatgtgtcagtcttcaagtgtgttcaaaatcggcagatcagccgtgcggctatgcactacatctatagtccacgatccataactgttgactatcatacaaagtgcatctatcatagttggtctggactcgctcggtgcaagtccggcatggagtagtgttgcatgttatatttagtgctttcatatcatccattgtgctcttatatcaaacgctctgacagggagactactgtgcctactccgaaatcattccactatagacccgagttcctccaatagatcactccaagatccttccaacaatatcactcttgtgtccaatggcaagctgccgctacttttccaaggcgtcggaactgacctgtgtgtagcattgggcgccctgtccacctgtgtgtcgggtggaaacatattggcaccttgtcttgacgtcctccgactcgtttcctgtcatgtatatattcacatcctgcgggtccttggaggagtcgaggagtcccacttaccttttcctttgattgcttccgtgtaatagtgtctcaatattaaatcgcacccgggttttatcttcggtaaattcgacttcctcggagtacttctcctctcattctggttccttgcctggagcaggtctcgacgaatctgctttcgttcgaggagttctgattgactggaagagacgcctggataggacctcagccctgtagaggatcttagactcgttttccgtacaccgtgcgctcgtcaaaaagctcgtgcccacaatagttaccaaatctcccgtggcgttaggaacggtgtagagcacaacggccgaggtggagaaatcgtggacttgttttgtgaggcgaagcacagtttaggggatggacgtccgaatactagtgtgtatacccttaacacctgattgtacttgcaaatagttccacactatttgccaatggctagggggcctaagctgcacttttgtcaaacagcatttcgttacaagtagtcaacaggccatgtcttggagtcaggcatctcaacgtgtcttggacaatcaatcatcttggaagaggctctcaagtgttgaactcctttcatttaataatgaatactttagctagaacaactcagtgccattgctatggtggatcacatagatgtggaacaggaactgtatcatgcccgagtctttgtgggatttgtgtcgtactcacgctcatggcgaacgcaaaggactgacaccgaaccaagtacttgtaattgcaaaaactacaagtttcagcctgttctgtctcacaaaatatgacagagttatgtcgaatttatatgattttacatcaaaatttcgaaacttaatgtctattaaggttgggtatggggacaattaatttgtcgcgttctaaggccaaatgtgtagaatttgccgaccaagctctaagaactaattatccatgcaccctgtgaatgaataagaaatatttcgtgaaaattatgatacagaaatcaagctgagagtcggaagaatccaatggcatcttaacatgtcactcgtcacttacaaaaatgtgccccatttgtatcactgctctgagactagtgtagcggagaaacccaaatgatcgcaggcagaatgaaggcgaggtctcttttgaccggtatgtactgcaatcgcctcataacttctccatacagcaattgtcacctaatactactacaatatcctattgtggcagtatttcactacgcattcgtctctctcacactctccaggccctctgctctgtccgagtttgctccaaacataaatcataaatcatctatatactaactactcgacagaagagaccttcttgatgacgatggcggtggaagctcctccaccgttgcagatggcggcaactccgtactcgccctccttgagggcgttgaccaaagtcacaaagattcggttaccggaggcaccaatggggtggccgagagcaacagctccacccttgacgttgaccttggacttgtcaattccgagtcgcatgaggttggcgagagcgacaccggagaaggcctcgttgatctcccagagggcaatgtcgtccttggtaaggccagccttcttgagggcggcgggaatggccagagagggagcaatggtaaagtcaatgggggcggtggcggcgtctgcgtaagagacaatcttggcgagcacgggggtaccgagctccttggccttggtgccagaggcaacgacaacggcagaagcaccatcgttgatgggggaggcgttaccggcagtgacggagccctgcttgtcaaagacaggcttgaggcccttgagcttctcggcgttggctcccttgggctcctcgtcctcggagacagtcacggtgccctttcgggtcttgatctcaacggggacaatctcatccttgaaggcgccgttcttgatggactcgttggcccgtcggtaggactcgatggcgtactcgtcctgctgctctcgggtgatgccgtctcgcttgttggtgttctcgcagcagttgcccatgtggatgttgttgtaggggtcccagagaccgtccttgacgatggagtcctcgagcttctggttgccgaaaacaagacctcgaccggagtagtagggggtgttggacatggactccattccaccggccacgataacgtttcggtcgccggccttgatggcctgggcagccagagccacggtcttgaggccggaagagcacaccttgttgatggtggtggcctcgacggactcggggaaaccacccttgataaccacctgtcgggcgggggcctggccggagttggcggtcagcacctggccaaacagaaactcgtcaatctggtcggcggggaccttggatcgctggacagcggccttggcagcggtgataccgaggtcaatggcagacacggacttgagggctccgttgaacttgccgacaggagttcgggcggctcctacaatgtaggcggcgttaagtcggggcagagtgagtcgcattgtgtgtgtgtggggaggatatgtgacgtggatggcagaaagagaaggaccgaggtatataagtataacccactaacggtaacgtgtatgcactgtctccccagaacacccgtcctttagctccctggttgcgtcggccctgttccgaaccttgtcgggtatcggtcggctcggcaaactttcgggggaatctggggtacgaatagcgggtgttgtacatggtatataccataaagggatgtaacaagaaacctgagagagtgtcttgggaggatatatatacatttgtatttgtgtcccgagcctgtttgtgtcgcatttataccaaaaggccctcctataaccccttgcctaatgccgaccgacaccctgctccacatgtttcccaggcacaagtcggactttctttttcttttttggaccgccaaccgcccgcgagtaaaattgccgtggctggagaccatggtcacgtgatgtgcccgaaggcgcgctgctgaaaatgacaatcgagctgagtcgccggttttccgcccctttttccgtcacgtgaccgaaacataccgttcctccgtctgttttcgttcctacttgttccgatcttgatcggcacatgtgcggagagctgtgggcgagaaaagacgttagcgtgatttgcatgtggggaagtgtggagagctgcagatggagttggggtctgtgtcaatgactgggtaaagagggcgtggtgagttcttattgcggtttccgttgttctatgttgtcatttggtcctataaagcagtattggcggctccatttttacgccaatcatcatgttcatcttttttttttccaactataatttccgctctaattcacaggttggagagccgaaaagtttcacccactccatgattttttttatttttttttatttttttattttcacactctcccaagacgtaaagttggctgtcatactgactggaaggaagtgatctaagacacgccaaatttcactcccaatatcggccaagtaacaagacactgtttcacgggtggtctgggatcaccgcagatatatatgtcgttggctctggtaattcgatgatctctgactggtcagataataatatgcggtgcactcggccacaaatggaaaaatggaaaaaaatggaaaaaaatcgtgtatatataggccaacaacttccctgtaggctcactacagatggtgcactcagcgttggacggagatacttgagcaagtacagtacatactgaaggagtacgtcctgttcaagtactggttaatactcgttaaggaaaacagtacagtatggcaacaagtgcctcaagagatgacttgaagggtgagtagtcattgccggttggagacaagtcggttggcaaaggcgtgatcggttggcaagggcatggtcggttggtcggttggcaaagacatggtcggttggtaatggagacatggtatacatgttgtcgacattcagacactcagacacaacagatgtctgatcacagtctgatgggtcaacatccatcagagagaggtatcttctcgaatgaaatcgtgtgcaagttctagtttgtttctcttcgcagaacttgcacacactaaataactatttgaaagaatgtaagccctagcattacccttgactagaaatcaagcgagttgcagggctaacgggtcccccagtaaaatccggttcctatgggtcgttcacgtttttctgggcacccttttgaatccagtccgctatagggcatgagcgagtggatcttcgaaggtgccgaaagatatgggtcgagctaaactacaatctcgtgtcgtcaaaagtgtattacggtcgatatgttgagggtcggtgatgtgacaagaagaaagatgggtgtcaccgcgcggtttatactttggcaaaaggttagggttggtaattgtcagactggtttgggaggtttggaggtagggtaaacgggacacctttaccactgccagtgtggacacagcacagatcatagcggtgggaatatgaagttatgacaagcccgattggtctttgtctcgatttttccacacagacgagaggacagcaaacagatcgaatagataatgcatggctgcagcccaacaactaatccttacaactgtaaacgaaccgtctttatatacaagtacgatgaaaaaggggctaagacgaccgcatttccatgtactcgtatgtacatactgtaagtacacatgttgatacgagcacatattctctggcaaacgtttatcccagtctggctgtctcaggctccctattctggccttgccgaaagtctacccttaaactgtagtgctggaaagggtcccgaggtctggataagtttggatcaaggagctaaccctgttcatgtagcaatcatggcatgtgttatttgtgtatgagtgtgtttgttgcggggcgtgtttttgtgtcggtcatggagtctgcttgcggggcgtctcaggctgtccctgtcgggtgcccgtatttcttctcccttccccagatcatgcgagattacgctgggcccaagtatgcgcgctaaatttaatgacgcaacaggtggaagcctaaagtacgcgtcttggaccggtgaacaaaaaagtagtctcatcatccacaccctccacagacacataccgcactatgggacgaccacctggatccggaatggacggtccggtctacaccgactacgaccccgccatcatggaaaaactcaacctgcacgtggacattgaaaacggcactctcacgaacggaccccagtgctggctcagtttcggggaccacatccccacctttgtgcacattgagtatctggacacatatgccatcaatggaaccacctgcgactctccctactactcgatgggaaacaagggctacctgggcgtcatgctgagcgtgggaatcgccgctgccacacttgtcaccttcttcaacctgagaaagcatggaatgaacttcatgcacgagcccaaggccgaggagctcatgagccagggcggacggcctagcaaaaccaaaacggccgaacctggctggattcgaggccgaagactgccctggttcctgctcctggtcctgggactcatgctgatcctcaccggcttctttgctgttgatattgaccgaaactacatccagggcactgctgcgggtatgtacggcgtgtttctgtctgtctgccctgttctgggactcatggtctcgtgggagttcattcgaagatggggtttcttcgaagaacgaaaactgctggaacaagacccctatgcaattgaccagacagacctcaaatccaaggcccgaatcatccctcccatcgtcttctacgtgagctgcttcttcgcaatgttcatgatggtgctgcggaactggagcaagcatctggattacaacacgttctttgatctggatgttcggtgggtcattggcggcatctgcgaggtgtttgccttcatccagctagtaaactcgctcagagtcactatcacgtactaccaggtgccccaggtgcctctagttcttcccttcatggtgttcatgaatctgctgacggaaatctaccaggtgaccgtcatggtggtcaacgacaagaccgtctcccctttctacccgtcttccagcgtcgttttgcctgtatttctcgtctacctgcctctttgggccatcaccattgctggtaacctctctggtctggctagagacaacgaggaccaggtgattttgcgtctgcgagctctccgttggaagattaagcaggagaacgccgagcgagctcgatctcaaggagaacaggaacaggaggctgcccagatagccgagcgacgagaaaccgacgctaccttcaacgagcagtaccctcactttgaggactctgacgctgaggccgacgaagagggatccgaccccaacgcttctggaggaggacgacagacttcgcggtaccagaaactgggcaacgagggaggcaatcgagctggtctgttcaaacgtctgtttggcgaatatagacccacaaacacctggtttgggcataacatggcctacgtgcctctgtcacgaaccaaaaatcagctgtttgacgaagaagatttccctgccatcactctgcagaagacccgggttcgatctgaggtgaacgaagaccctgatgaaatggagggtgggtttgacaactaccacaagccgtctctgttctccttcttgtccaactcgttccggcccattccgtccaaaggtcggcgagacctcaacgacctggagatgcaggatctcggcactcccaagagcatcaagcaacagaagctgtatggaggtagacgtggttctcggccttgattatttatgtatagatggattagatgtttcaccttgagttggggggatacagtatatgtacacatggtacaagtagtgatgcctatggaagcaaccctctttgttgtacaagtaccagtaacggtacaagtggaaatgtactgttgatcagattgataagatctcagactgcagtgcagcagtttcacatgtcttctgactgtcccgcatgcccttctcatactgtagaaaatatttactacggggactgtagagtttcccgctgtagataataatctgggcaccaaaaaaaatatggaccatctggtagactatatttagcatgggaataattagtcggctataacatacagtctatggggtgacacattgtagacttcaaggcggttatggatacagagctgtatcatggtgagcttgtggtacaactacgtacagggtgcgactcttctgagcatatgaatgtactgctggtacttgcactcaccaagtcatagtaagtaaagaactgatctaatctattgtataaataatgcatgttaagggccgaaaattcgcatcttttcgctctccagacgcgaccgcacggcaatacgagcctgggcgagcagctcgcggttagtatcttcgctcagagtggcctcggagacggctgtggtgcgagaactgatggaggttgtggacgtcgcggtggagacgcacgaattgatggaattggcagattcgggagaggtagaaggagcgtatgtaggaggaggagggatgtgaggcgcaccgcagccgctgccaaggctcatggtgctggccttcttcttgagccggttagacgaagaagaggtgccgctgttggtgatgggcaggttcggagtgttgtactgccgtcgaggagaccgggtgggcgagctgttgggactgggagatgactgctgcttggggggactcagaggagggtcaaagtacgacttttgcttctctggagacatgagcagaaacagctcagcgtgagacttctttcccttgagcgacggggtgtgagtggggatgttaagagatcgcacctcgagtttaggtgatcggggtgtagagggtcggggagcggcgttgggaatagctgaagactcttcaagctggaagatggtgtctctgagactgtctctagaagacgaggtgacaaagtccttgaaattttccttagaggcagacttgtgcagcttgagagttcccttggtcgactccttctccttttctcgcagtcgttctctgaacgctcctcggtacagtctctggacctggacttcgactgccagcttctgcagaaaggtgcggatgatgagggcacgctcatccttggtgaagttagcggagctgggctgtttggcgtcccgagtgcggtcgatgcagtctctcgcaaaccgcattcgggtgtttcgagcaatgttgtgttcccggtagagatctgagtcggccagggtgcggatgtactcttcgtcggtggcgtcggctcggagcagagtgaacttgcagttgttgagcttgtcgataactggaagagtggacgaatgggcaggcatggcggtcagaatacagacgcttcgaaacttgtttttggcccagtcaatggtgattctgtgttggtcgttgaacagctggcgctcaaactcgctgcggttgtacatgatgtcgagtttttccacctcgctggcagtcatgcctgtaaagtcctcctcggaccgtgatggtcgcagattattcttctcgctgctgagagctgttggaagcacctgatgcgaccgctttttgttgagcttgtggcgcatcagacactctttgacgtccttggtcatgtcttccgacgagtctctgcggaacggagtgtggatctggcgattgcaacgcttgtacatgaaggtgagagacttgatttgcaggtcaatgtggtcctcgttgtcgccctggtagtatgtaggaatggtgatggctggggtcgttgaagacggccatagaaatgagaatagtcctgtcattgttgtgggcaataaacttgtcgtcgtccgtgtctgtcggtgggtagggaatgtgtgttgtgtaaggagtgaggggggttgtgggagatatgtgtgcgtataaggagtgtataggtcggtgagatatgtcggacgactaggtcggtatgactcgttattgtggcgagcgggagctgtcgagtgtgtattggagaggtcgcaatgagaggtggtgagtggggaacggaatgaagagagtcccggctgagaaggtctaggtgtatatgcagttgcgaatgaccagagatctatgcacagaaacgcagctgagctgattagcggacgaacctagaggcggcagacaatcaaagcgggtagggtcagctggacagacacagagtatggtcccaggagcgttttattttttgttgatatgtgtggtatgcacggggcgcgcgtctggtctgtttgttatttcaactttcagctgtatttcagactaggttggattgttgcagcggaatgaaagacactgttggtttggcaagtagggtggtggttctggagccgggaggggtcggattcggcgaccgttgcgcagctagaggggcttggagagcaattagcccggaatagagacggttttcggtcctgttagtgcctcagaagaattccgctagtgtgcctgtttgcttccactgtatacagtttttatgcaggctgggcagaatggggtgattggccgcgggcaggtatggagaatggtggttagagcaagggccttgaagaatgagctgagctacaagtaggcgcacttttggcggacgagacgggcttttgtcggaaatgagtgcacaagtggtgtgatccgggatggtgtgactggaagtcagggtgtatatcgtcagacttgagtgtaataccggcgatgaacacggcaaggctgttatcgtgagagacgttacggagatatcagccttgtgagcctactatatatcctggacatgattgtgcaagtctattaatggccagcatgcgcccaaaccgcctggtttcagctcggcctgagagcctacagtccatgttttttcccgactatttcagactcaagacagcctttgtattgtttacttctgcacccttgtgtgtgggaggaaccttgagtttggagcagcggggttgtggagggatatatcagggcatttcggggcggattttgacgcaaaaaacgtctgaaatggatactaagccgtttaatatcagatatttcgactcataattgcagtattcctgctcaaacaccccaataattctgcccctcacctgtttagctcccagacaaacccaaccctaaacgcaccataacatgtgcaacagtgtcagggcgcgatgagcaacttaccgtagcaccaagtagcggacatttgaagcacggaatgctggaacgaggtgacaatgtcatgtgtcatgtgccgatgagggccgtggagtctctaccagtctgtgtaacattggatctgcgtgctcgtaaagtacacaaagatatattccgagcacaaccgccgccaaatcgcacctacagcacctacaagtagctaccccctctaaccatacagcataataccactgacaattgctctctgctgagcccctgaaagttgctctgatcctcactgatagacagacggcttccatacatatccactgtggagaagcagttggagcccaaggagctgcagtgcgactcaatacacacaagcccatagttacagtgttcttgtatagttgtgtagttgtattcatttgctacttgtagtgccattcttacagcacagcaccatcataggatacaccctctcacatgttacttgtacattgtacatttgtttttatctaaaagatctatattggaaggctacagtcaccccgagatggcaagcgcaactgatcgtctcagcaaagcaggggtcttcaacttcagcgtttcaccttgtctcaaccgataacgtaccgtccccttttttttgatttttttcacatacaatagccggacctgcgtgctttaatcttgcgttaattatgagtaaaggcacgaagaagcatagtgcaacagaaaagtgcctgaaaacagcacttgaaacacagtggagagaaaaatatcaaatgaccacatgtcgcttatggcacgtctatcagcgggtgctcgcaccagcaccacccgttcccgcatcgctacatacatctcatctacatcacatcacttccttgctctattactatactctatcaatgtccttttatgccaccttttgctcaccggttggcgccactcagcttgtccacctcgtcctgaagcgcccgcaggtcagccagaagatcggggctcgtctggctcgaatacccgttgccgttgaaggaagtctgcgggggcgcagaatgcaacgccgtagaccctcgtcttggcggaggcggaacgggagcctctcgctgaaatgacacgggcggtggctggggagatgcagacttgtttcggggcggcggaggaggcggaggcacccgtcggcctcctacagcattgtatccaccgccgtttccaaatgaggtgggtgtgggagacacgctctgtgaacgcgacactccgggcaccatgagattgtagaccgagttcatattatgctgctggtgttgtgactgctgttgctgctgttgctgttgctgttgatggtactgatgtggttggtattgttgctgctgctgctgctgttgctggccatatgcttgttgggtgtgcggggtggaaaacacgccagacagaccagagtagtttgtagcggctgcagatggctgggattgagtctgaggctgcggagtggatgccggcgaaggcgaatacgacgagttggctgatccgtcgccgtacgacatgtatcctgcaaacgacgtggaaggagctcctgtagcctgtcggcccaaggtaggcttaaacgacgagcctgtgttagagggctgcagattgttattagtattgttgctgttgttgctgttgttgctgttgttgttgcccgtggcctgagacaccagagcatctctgaatgcgtctcctggagcaggagatcctccaggagcaggagatccggtcgcctggctctgcagaatgtttctgaaagcatcgccgggcgtttctccgtaagtgcttccaaaggtgatgggaggaggtcccacctggggtttgccgtggtgcagcacactgtccaccttgacgttcttgaacccactgtcctccagagcctcaatgacctcgttttcgtcgtcctcaccagtcgaagggttcggaggaggggcttgttggatcggagcagtcacagtcaccggaggtggtggctgctgatgctgctgaggaggaggtggaggctgcgactgctgttgctgagactgaggttgaacttcagcttgaagatcctgctcagtctggtgcatatatgccatgaatgacgttcgaggtggaggccccgtctgctggcgttccagaggcttgggttcatcctcttgggccgtatcatcatccaacaaatccgacatgctctgcgaatagacaggggccgaaccgctctggcgctgtcgcatgagctcctccagcgtccggccggccgcagcagtcacctgcggaggctcgctagtgaactgcaccttcttcttgctctttttgcgtctatctccggtcaacagtagactggtgaaggagttgatgtccagcggggtgcctgtgggggtgacggcgagctcgggctccgagtttttgcgcttgcggctgagaatcgatttgggccgcaacagaggagctggctggtagatcatggccgcagacacattgctgccattgagcgcatggctcaccagtcgtagaaagccgtagaactggccagggtccagattgaccaggtgctggccacatgcattgagaatctgtgttagaatcactgtaatatgatggcaatgtctgctgtccctccgtctgactcaccttttgcttgtcctcgtccttgacgccgaaattgtccacaaacgtcagcacatcgccgacaacaatgctctctttgcccttgcgcagcagcaaatctgtgtaccaccggctgtacgcgcggatctcgtcttccgtcagcgacagctgctcatatctgatggactccatgcgtggtttttccctccaagtggtctctaaaggtaatatgcgctgcggtctcggttcctattgtagtaccagtacactcgtacgtgtaagtaacttgctgactaagttgggaggaagaggaagggccagaagaagggatgacaaatatagatgggggcggagtcgactgggggatgggggcggagttccaggggtctgtttgggccgcttggtctacatttaccactattttcgtcccggtcacacgaccccatccccgatacttagggctcacttgacccggaattaacggctgtcaggggcgatctgtaagtgcggcaaagatacgatgtgggacatccgggtgcatgtgggaatgtgcgtgggtgcaccaataggggattcagagggacaatggagtgtgatcagtgttataatatcccttttcagtggtatttttactcgtacagttagtgcactaacttgtatgtcgattgtacggcgctacactacactaccagtagcttttatactgtagtgtatgtactacagtacccggacgtatggctcagtatcaaggggggctaaaaacgtctacaactcgattttgtgaaatgtgcaaaaaaggactctacgaaatcaaacgtggtggcacaaacagctgtcccaacatatatatattgtgccatgccctctcatacattcgcctgtttctacaactgcgtcgactggtatgtactcttgccatttccccttccgtcacgtctaaaactaaattaagccgtttcgcgtttattgcatgctgcagtatcgcacgttaattttttggtgtttgatgtgattgtcgcagcacccactccgacacaaccatagagacacaatgtccgacgaagacgagtacttgaggcagcaaaagctacaggcggactacgacgagttccaaaaggacgtggaggacgccgacggagagcacgtgctggggatgatcgagagagccaatgaggtcaaaaacaagtacaaggacgaccggcgagctctcatcaaggacgcagatctgctcaaaacggtggcgaccaaaaaaaccaaacacatcaagaagtacgcgctcgcgcagcccggcaccatcgatctcaaggaagtgcagaatatggtgaccaggtttatcgacaccgccgccgagattgaagaccctgcctttgatcgcgtggtggacgcttttacggggctctcggcggatccgcaggccgttcctgatttcaagcggatcgcagctctgggccgggtcggtatgaagcacggaagagtggctcgtggagcgtctcatttgattggcgctctggagaaggatcgaccgcaaaaggtgcgccagatgaagccgcgacaagacccaacagaggtgggaacccaagaaaaggccaagcaactcaagggcgacgagatcgacagtaccaagaacaacattcagagattcggaggaattatgagaagaagactcacggccgaatacaactaccgaaagcagtgcggagaacctctgcccatgcttcaggccattattgaccctcgaagcttcgagtcgaccgttcaaaacttctttgtcttctctaccctggtggctggaggaatggctaagctgtctgaatacgaagacaacactcctgtgattgatatgtgctccgaggaggaaactgctaaacttgtgaatgatagagattcgcggtgtcccgttgtgctggaaatggattatgagacgtacgaaatgattctggatgcgtacgagatgcgaggtcaagaaccgttgttggacctgggtgataccaccatgggtttgagtgcagagtagagtggaccacatgaccgaagcgaatgtgtgagctcgtgtgcacttgactaatggagcttgaggcacttccatgagtgaattgggagcactcgctggtgtggggtactgagggatgctgttgaagtatcattttgggtcatgcgaccttcaagaatgcagttgagggtacaagtactgtgcattaaatttatttattgacgttgactgttgtagggagtatgatttagatattgtggtggtcggcgtgacagatattgaagttgtacttctataccggtttatgtatgagagttagcccacaacgtagaaaagcgtatcatttagtatatgtttagtcagcatgatgcaggcactcaaaaatacttgtacaagtacatgtactttccacgtccacgacatttccacttccatcattctacttgtagaattgtacatctgcttccaaaatgcatgccgtgtacttgtatatccatgccatcttccgtgcatatcaacgaactttggactctataaacgcacccaccccgccactcatgtctacactactggaagtactgggattggacaatcgtgaacacagcccatttgaaatcgatcaggcgtaccgcaacagaacgtttcttgcgcttggactcctgccatcggactccgatccgttttatgcagtgtctgatgcctatcaggtcttgagaaaccccagtcaccgagccaagtatgtgaagctcggagataagcggtttttcgaccagtgccgcaacattcagtatatagatgctgtcgacattcttctgggctcatttggagtggacagactgaagtttctggttgccgacatgcctgcgttcagcaccatagtcaattgtttcaaagagatgaaagagattgctgtggctgctggacctctggacatttcaaacagatccctggacatcatgcgacgcccaggatggacacaggggaaagccaaagttgaatatcagtttaaatgcaccaagggagactactctcgcgtgactgtcatgccccagatgagagaaatgcagcatctactagatgaatacgacggagaaaaggggaaccgacaggttgcagagaaactgctagatgcgttcaaacaaaccactctagggttggactggatgcatgtggttgctgcagtgttccgtacccgcggaaccaatcagtataacaagtgccgcaagctgatcaacaacagaagcaatattgagtgcccaatcaagagagtggcttacatgaggaagtacgtgatcagaacccaaaagttctggaagtatgccaacaagtcatacgatgaccaggtcaacctgttctacctggcgtgcgcctgttctctcattctggaagccaaaaaggcgttagacaagactatcgattatctgtttgatgcacaaagacaacagatctcgaaacgaaaagacagaatggttcctgctaaacggctggcagacctaggggagtggatgggccagaaagacgaggtgttcatcacttacgatgacgttctagcatccgcaatcacacacacagcttatcacgttgtctatgttgtaacaaagatggaaaaagttgaccttccagatatcagatacagccttcccaaaactgacttcccagaccgatcaaagaccttggtgaagatggcgttggatatctacaacgcagaagatctttcggcaggcccagatcctttcaattcagacctcgtggtttggaacctggcttcgatgaatgcgttgatgactggccctactcctggaacctattactgacataatggcactgtgatgtataataatacggcagacgacggaattgattcatatttgttgtagacggcactaacccaacaatttaccgtcccgataatatggtccaactttttagttatctcagtctcggtctcacccagatgatgatgccatgtttcacaatgtcggatatctgagttttcttgggcaacatccatattagatattctaagacattatcgcttgtaaatacggcttgaaactagccccagaataattgctaaagccacatttataatatccatgtactcgcttgcagatatctccattatttatgccccaagtcgccgtttcaattttggtcacgtgattttctgaaatttcgatttggtatatttaacgcatcaccgtgactgttagaacacaggcccggacttcggttggtttgactggtaatactggcgacttgccataggcaagtcgttgagcaaatactcgtgttgaaagggtcaataatcgatatcctaaatacatgggaaatgagagctatatataataatgacaacggaccaactgacggatctgtaactcaacggtcgagtcctgaaggactcgacagacccctacgatagtgggtctttgaccagaacgggaactacaaggacccactcttgagagttgacaggtagacgtcaccgcttctggacgtccgcagtcgcgatcatcgcgacgtccggacgtctaccgacagacggtgaccgagaggtgcaggactgacagttgacgcgggagacagcaactgagcaccgacgacggtcgatggtccttgtgccataggcacaagaaccactaaagaagatcgtttcctaacatcagcccctcctaagacaaaggcatccatttcgaatcaaacatcgaaatactttgtctgataaactcgataggaaacgccaaaacgggactctcatcgccatgaggacgagacagagtcgacgggactccgtccggaaacaccacaattcatccttgacttacacaaagttcaagatccgaataaaataagaaccaagaggatcaagcagttcactgctgaagtggtagtggaacataacgagtagcccatcgacaagatggccacggtgaacgggaggattccaccagagcacgaatctctagggtcatcaaatgacaccaaccaacaactccacaatacattcgacgcgactaccaagtgcatgcgcaagcaggccaacaagacttttgaattggtcttgacgaaggtagagcaatcgaacagaagagcactgaaactaagtcactgtctgtatgaagacagacataccaccgaaaagacaggcttagtcttccccgggatctgagacagattgtacaagagatacaagatgcaagaagccacggggaaccggcaataacaatgccaccgaagctctgaacaccacaacacaggagcataaactaccgagggtgggtcgacacagagcactcagaccacgaacacggaacaagcagtcagagacgaagtacaacggctgataacacatatcgaagagcagagcacgaagtacagagacaccccagtcgcggaagcgaagcgacgggcggagaagacgagtaccgacaaggtacagagaacagagcggcacgaagcagcacggagcgggagtagggggagagtgatcacatgagagcatcggacaccaagatagaaggtgtggaaaacatccaggaaagcgagcacgaagagcgtgactcagcagtgacaccacgaagcgcagacggacatggacagccatggaagcagcaatgaggccggaacacgaaagcaataacgtgaacgtagccacgagcctcagtaacagtagtgcaagcatctacatcagcattcagcatcagtttcagcaacggaatcacatcgacagcgattaggcacgtaacgacaatatcgaatgccacaggcggtaagcagcactcaggaatgaacacgaaaacaaaggtctcattccttccatcctcccccaagatgacgacgtcatcttaaccaaacagtaacaaacagtaccgttcgaatactcaccagaacagaccaatagtccgttacgggaactaactatgagctagttgaaacacaggcaacacagcctcaacagagttgacttgtacgaaaccaacgggaagacgccgaagattaatcacacagaccaactaactggaaacacaccacggagcgtgtttaacgaaaggacgaaatggtgagaagtggcggaatccatcgaaacacaagacttggcagacgtagcgaaaccacttaaggcaacaagcccacaatagtggccacgactcgcaagccatcagaaccactgggcgaactcaccatgccagccgtgagggctagcactccaacatgggtccagaaaggacgtcgttccatccgaaaccctactaccggtatcgcatcaaaacgaacgggcacgaagcggtagaatcgagggtcaggcgaaggtgtagctgctacatgcaggatgcgacgcacggaaacaaggaacgacacgagatacgaatgtgcagcgaaaactttaacgcaaaacagacaaagcactcaatagcgaagagtcaggcacgagatgtgacctgagattgacaggaccacacatcccatactgctgaacacgaatggcggaggacaaggctaaccgttactgaccgtgaccagaagacaggtcacgagtacagtattcaagataccgacggtagcgacttaacgccatggatgacaagagtctaccagcaatggaaagactcagcgacgacagtggaagcgacttagcgaagttcgacagcgaaggactcttgatgaggtagccagttcattaagttgtctacctcaccaaggtgagcgacccgctgctacccgcaatggtgccgcgaacaccagggcaactactcgaacacatcgagtcacaagcaatacagacctgccttgcctcaaggcagtctgaggatgagagacacactctccgagtgccagaaggaacgaatggcactcacgtggacaggactggtccacgtcgacggacactgactgatccgatacagactcgccttgcctcaaggcagtccgggaataagagacacactctctgagtgtcggaagggacggataacactcacgtggactggcccacgtcggcgggcactgactagtcccgacacggactcgccttgcctcaaggcagtccggggatgagagacacactctccgagtgtcacaaggaacggatgacacccctgtggattgggatgagagacacactctccgagtgtcacaaggaacggatgacacccctgtggattgggatgatagacacactctccgagtgtcacaaggaacggatgacacccctgtggattggactaatccacgtcgatggacgctgactggtcccaggatacctcagccttcggtaggctcggaaggtattcacacaattggcaaggccctataccacatggctagacgccggccttgctacctcgcagtgggagaacggaactggataccaccagcttccacactgccgtgagctcgtgtccttagaactcacatgactcctccgaagacgacagagatgagtccaaccctccaccagggtcatcgatgggtcgaacgtaacgaacgtactcaggctgatgactatcagccttccttcccacctttcatacctcgagagacggtgagaaccattaacgcgcgagaagtgttgatgtccatcaacaactaccttcccaccttacacctctcgagagtactcacacacattcctccgctcctcactcagccctcactctcacctcccctttttcaggaggccgttgcttgtcgaagtgttctgagacgactgcggtggcggcatctcctccttcggagaacacttagcacctttatgagagactcgtccttactcgtcaccacccactaccagcccaccctaaaaaaattccaggggttcaggcatcgactcctggggagtcgctatcacgacgatggcggggcagcgaaaggacgttggcaatgaggagttgttgctcgtcgaagtcagtgaccaaagggcgaggtcctttcacccggatcgagatgcaacgaagcatcgctaccatatgttagaacacaggcccggacttcggttggtttgactggtaatactggcgacttgccataggcaagtcgttgagcaaatactcgtgttgaaagggtcaataatcgatatcctaaatacatgggaaatgagagctatatataataatgacaacggaccaactgacggatctgtaactcaacggtcgagtcctgaaggactcgacagacccctacgatagtgggtctttgaccagaacgggaactacaaggacccactcttgagagttgacaggtagacgtcaccgcttctggacgtccgcagtcgcgatcatcgcgacgtccggacgtctaccgacagacggtgaccgagaggtgcaggactgacagttgacgcgggagacagcaactgagcaccgacgacggtcgatggtccttgtgccataggcacaagaaccactaaagaagatcgtttcctaacagtgacaatgttagggatcagcggctaagaaatagccgcctgattagtctctcgtgaaccgctagcggagactacacgaggggccaccacgtgggccctcagtgggattacgctatcattaatatcgatatgccaagcctgctatcacggacaaagggttgcgccgcaaccctggataacatataaaccccggaaatttttttaggggtggctgggtacaggtagaggcgagtggggacgagcctctctagttgtcggcgtctctttgaggggtgaagattgtgtcaccctggagtcgcagtatcgacaaggcctccgtgggaggaggggagagtgagtatgcacgagtggtaggagagttggcatgactatgactactctccaaggatgagaggtgagaagaatggcgatggctatcgacatgtattggtgtcatatcgtctagcagtctcatcctgtcgtcgtgggagtcacgctccggctgtcgaggagctggctgagtgagtgatggtatcgctggctgatgtctgtggatgatgtatcccagagtgacgatgtcggtgatggagctcacggcagtgcgacatcagacgtggcgtctgcactgagaggagcgaaggtgctgcggttctgccagctttccataccttcctactgccataaggtggacagtcaagttcacaggagtgacgtcttctccccaaggaggcgcgctcgacaagaggacgtatcttgcactcgttgtagcatggttgctccgagtgaatagccgacggtctttggttcggctgcgcttcataggaacggttcgagagtcgtttcagctgcggtggagggcatccccatgaaggattccgttcagcgttgtcgtcatactcggttacgacgcatcgaggccactatgttgcggaactggcgtgtgtctgtgattgcttaaaggaggcttcatgagacgactgatcctagtcgatggagtgcaatggtacagtaacatgttggttgaggaagataggctccctgctggtgtcttccggttgaattgctgcaaggtgtgcattatctgccacataaggtttgtgttgggctgtgtccagctgcataacacatggaactctgacgactattgtctcgtcgtcttcaagagcggtccgggacgtcatatggactcgtgagaaagagtttgcaattcaagagtgtcttcgaatgacacggttggcgtaccaacgattgagattctctctaaactcagtcaccggtattggtcagctcaagttccctgcgacctgctggttagtgtcgctggagacaagaacttgtcgcggcatacccgttatcactgaacttggtcatggctcgttcgtgatgtttccccctgttttgtaagtctgttgtgtggactttacaagtagtcgcttccactgccaaagcctccgctacgttcgactaggttgtcgtcctgaggtgagtaatgacgtgttgttatcgtcatgttgctgttctaagggtttagaccagacttttctttctgtctgtgtcggtagatcccttggagtgtgttaagtcgcattgaagatgatgctatcatcttgaggtggggtgagaaaggaacgaaacggtttctgatgtttctatttctcgtatgtcggtttgttcatttcggtgtggattgggatgaacggctcagtgttattgctgaggttacgttggtacagtacagccatctctggtatgttagagatgtgagagtctgctctccgaggcgagtttcctgtcactggaactgttgaagcctagtcgacgtggttgtcggtgttgatccgtcagctgcgaagttggctgtgttttgccttgttattctagacattgaccccgggttgatgtcgtcggctgtgattgttctctggtcatgaggagttcaacgtgctcgtgtaagttctcggtcgctgagagctgcacctattgtatggatagtctgatccataagatctgttgttcacggagatgtttgtcttggacatctcgacgtcgaatcatggtgcttttatcgtgtaagatggaagtcgctccacgacttcatcttaggggaggatgatgttagggatcagcggctaagaaatagccgcctgattagtctctcgtgaaccgctagcggagactacacgaggggccaccacgtgggccctcagtgggattacgctatcattaatatcgatatgccaagcctgctatcacggacaaagggttgcgccgcaaccctggataacatataaacccctgtattccatgtattctaatacacctttcttgagagtgacggcagtgaccataccttcggtatggccaccccggctgagtcatcagtcggcttagtcacggggcctgggttctaacagacaagtattgtggcccgatggtttagtggtataattctcgcttagggtttcctgagcaatttgcgagaggtcccgggttcaattcccggttgggccccatcctttaatctcccggtggccaagctggtttaaggcgcgagactgtaatggtatcatattgtaatcttgagatcgggcgttcgactcgcccccgggagatgtcttttttctgtgggatcgtatgactccaggggtttatttttgctctttagttttcgggtgccttggtttcgcatgtataagccgtaattcaacatgggggcaagacagtctcagcccagagtggcaatttccgttttaccgaggttgggctttgcgagccaatttaggagtgtttatttcccatctggagaggtgtgcacggcgttaaatgagctatttgggtccttggctccggatgagattgctatcagatcaccatgcctccataatcacactaatttggacgcgtcatatttgtaccaaactcatgactgcgtcattagcggagactcagaccatgagggcaattgagggtttaagccaaggttcggttctttgatgcgctcttttggtgatgcattcattcttgactaaatgggacatttggttgcccgaaaagatcaattcgcggggactcgtggaatgcaaaaacgtgccctcggccatgtgcccagattaccaccacgggcttgtgtgcgacattatggatccggtggaactggaggcttggtccgtctgtactgtagttgcgttacgtgttgcctggcttagcatgttcgcgttagcccgaaatggatttcgtgtgagtcttgcttctgcttggctgggccactaacaagacaaaccgagctacgttttgctagaatgggccatttgggctctgcgcagcccccccaatttcggtccagcaaatccgcctgctccttggcttgtttgttggtgtgcctcaaagtgccctcttgtgcggcccgccaatcgaaagtcgcctgggcgcaaagtgagggcagtgggccgaatattattatctggcttttttggcatggacgatattacgatattagcaggccaattgctgtgttacaaactcgtactgtagttgcaaagatgggggaaagagggtaaattaattgaagtgagaccgccccaacccaggaacaccagcgtcacaaatgtccaccctttctgaaggccggtttaaccggtgcactggaagacctaccgaccttgtgctgtagatgtattattcgtagggctacaggagctattttaagatcgcagccgaatccacccctatacaagtacggtacgagtacttagggccctagggcctgtgtcagcccctgcaatagacaggtgcttttttttctcgttttttcccaaaatacccgtctatttccgtcggccctctttaataagcagacgcccttccgtgaatagggcctgggccacctgacaagacaagggaacggctgacgtcatattttgtgccctgtccgcttcgcatcggcgattgggtctgcgagccgcatatcccaaaattagttccgacgaaatggaggtcagcaagcagaaatcatgctaaggaccatgtatccacaagctccttactcgtcggtggcgagtcgagtggagctggacaaaaaaaaaaccgtttggacgacccgctccagaagcgcatgtaggcccgggcaaagagagagagaaaatgcgacattcctgactcggttagaggataatatccgggaagcacggtgatgcgcggggcatctcgggccagtcaacacatatttccgccccagaaacactacaaaataaaccctcttggtgtctctgtctgacatcaccaccgtttgcaaacgattattagccccaaagtaaaaagcctaaaactccaaatcccaacaaggttaagcttctttgtcactacaaggttgaggtgtgcgtcgtcactgcgattcgtatttagacaggcctcaagtcccgggtggtatatatattataagtctctctagcgccatagcctcaaacctgtgcttgcaacacgctacaactaccggctgggaaactacagacatctctccataccctcttcttcgatacactggcgacgtggaactggcttcgacaggatacctcatcccaactctgacgtcattacaccccccatccccccatcccctagatctcagatcccctaattaaataaatcggcaaaaatcaaaccagacaaaatatcgcgagtctctcgatattcgccaccgcattaaaaacccatgacaaaacccacaacgccactgcactctgttgacttctacgactggaacgtgctgacccagttcaagctcaggggcgacctgttcaaggaccccgtgcttaatcgcgtggcctcctacttcaacgagggcgtcacctatctgctgaacggcggatatgtgtacaaggcgcggggctcgggcaagtggatggcactgcccaagaccgccgccacagacgaagcctcaaaaaccgcgtctcctgacgccaaccgcgactaccccaaggagctgctggaactaatcatctcggacgcagactcggcctcttcgctggaagagtgcaagattgtgggccgcgatccgtccagctgggcacctgagcatcgggtgcttctggagcgggccacagagtccaatccagacctcagcatcgtggccgactttctcgccatcggaggcacctacgccaaaaaggacaattacctgttccgagtggacaatggcgtggaccgtatggtggtgccgcgaggcgacgtacgcgaccaactgatcagagaatgtctggagggcatcagcgaaggagaagatccagtggagcgggtccaaactatggtggctcagtattacgtcattccggaattggaaactgacgtggtcagggtcatgagttctgaggagggggagaagcggctgcaacctactacaaaagaggctgctattgcaccaaagactccagtagtcactgctgctgctgctacttctactcccaccactccctctgcattgtcgtctcctgcatccgatgtgtctgttgccccatctctataatcccctgtagcatctgcatttatttatttgtgtttattattgctcttgttgttggctgcacccgtcgcgttgcgcatcttagcattctggagtcccctaatccgtcgtgaaacctcctattatctccatccagcgtttcttctcaagggatttccccacatattgcacagtttcaaactctattagtagagtaagactcatcaactctaatccgcctggagcctgacttagtcacatccatcagactcacatataaggcccccactggcttcatggccatcttttctttctccttctctctttccgacacttttatttactctacgctatttattccagcttcgacttgccccatctccccgacagcaacaagttgacccttatttattatgaccagagtgagtatctgcttatctcgatcattcgcctctccgcctccctccacatacaacacattaacacgccttgatacatcgtgagcaagttgatacgaggcagggtccacaaaaacgagtgtagaggtgcttgtctacatgtggctgtgtctttggagcacatgggaccatctccgttggagtggcttgattgcatatcgtgcatatccagcaggaccctcacagcaggcaaagataagtattcgtactaacacagatgacaaagtgggaccccgaaaacgacaacattgtcaagagcttcgtcaaggagcatggccgcgagtggtcgatcagcgaaatggccgacgaactcaagtcacaactgcctggtttcgacaactcgtctattcagcgccgcattctgcagtggctccagaatccaagaggaccgtctgacctcctgtgagcagacagcatcattacacgacacaaaaattgcatttacatagccaaggcatggattaaaacactacaagtagctgtgaggcgtacgatgaagtacacgccagtatgggtacgatacgataccagggcctggcacgagtgcatacttgaactagtatgtaaggtatcgctacaaaatgttgtagaacagtatgtacgagtatcgtacttgtatcgctcgtacgtactttacttgtcattatacacagttatctttattaatcacatccagacaattccacctttcactttgaggcattacgtgatgcgtccaaaagtgtgcctcattttgacgttgacggacgttagatagtcttagcttagtctataaccccaagttccatgacaccccacaaaaccatagcgttatccgaactcaaatctcagcacttataagccgcgaatcatctctgccaagggccactctgcaaccgcctctcgttaccatgacagcctggtccatctgggaagaccaggtcatttccgtgcatgtcaagcaataccacaaggcctacacggtccggcagatggcccaggagctggccaacgccaatgtcttcaaaagtcgaactcttgcggagattgaacaaagagtctgggtgtgggtggaggagggaatgttgttttgaggggagtcggactcagttctggtacggtcaagtctcaagcaagcaacagcaaaaaagctattcactgccgtgcatcacccacccggcgggttttcctttacacggttggactcgttggtctgacacatgaccttcagcgtcgcgagctaatgacgagtgcgggagagtcgggtggagcctaaacccatgacgtcatggcgggttcccgggactcgcaattcgtgtatctgccctttatttattaccaatttatttatcacgcatttttgaagagcaatcacaacaacttgtattgattacgtatcgtacctccactggcccaatatgatactgctgccaatcagtcggaagaggctattactgcatttttgcccgttgtgcctgacaacaagcaccccttccccgcctccaatgacgtcacccacaccaaggtgaaacttacaataacgtacaaatacaagaatattaattatgtcgcgttgttcaaatatttgagacacgcaaaaacatcagctaccagtatataatatctctctaattacatagcgccatgtgaccctcttatctgtacgcacgccatccaggtattgtacttgtatttcctcgaggctattatgaaacgcaacacatggcagagtctcgtatatcaggcggagctcggttatgtatctattagattatgcgcatttcgttcgttttctccgtataatatatcctcttcccctaggcactcttacccaagctgaccaggctcttaaaccgtttccacaggcccacaccatagccagcaatattcacgttcttgacaaactcccatcccttgacggcgctgggaattggatattgcagtggccggggcagagtggtcttgcagaagggcacagagtcaaacgccacagatttggccagacacagaccctgcagaccctcctctcctccaaacttgccgtagccagagcccttgcagcctccaaacggcagctggcacacgtagaaggctgccagatcgttgacggcaatgtttccggacttgatgtcgttgatagcctttcgcagcgtcacagtgttggctccaaacaccgcggctccaagaccgtatatcgtagagttggccagatcgatggcttggtcgaccgtctcggcctgcatcatggtcagcacggggccaaacacctctgtctgagcaatctccatgtcggcagtgaccccaacgagcagagtgggttggaaataatgaccctgggggtacttggggtgggggtatctgtgtcctccagcaacgagctcggctccttgggcaaccgcgtcggcaatgagctcctccagacgatcaaaatgcatgttggaaatacacgctccgacatccacgtcgtcctgctggtcgattccagctccaacacgcagcttggggatggtttctcggaagatgtcgagcaaagttttgtaagcgctaggctgggcgatgacacgctcgaaaccaatacagttctggccggccgcctggaaagtgcctctcaaaatggtatgagcgatggtcttgagatccagtccatcatcgtcaaagacgacacatgggtccttgcctccaagctcaacgacaagaggaacaagcgactcggcagcggcagctgccaccttgtgggccacgggtttgctgccaatgaaagtcacgtgcgagatctgggggtggctggtgaggtggttagcagtctcgggccagcagcacacgagctgtacgagatcgggcgagtggccacaggcctggagcgcctcacgagcaatctgaacaaagtactgcgacgaccagacgacggactcggagcatttaatgatgacggcgtttccagcgtacagagacgccagaatcggccccatgaggttatggagagggtagttccacgacacaagggcagccacgacgcccaaaggctcatagaccaccttggcggccttgtagaacatgagagggttggaggaacccggtcgtgagctgggctgaagggctcgttctccgttcttgatgagccagttgatcttctccaacgtcaccatgatctcgcccatggatgcgtcgatcatggtctttccggtgtctcgacaagccactcgagccacgacctcctggttttcaagcaagaactttcgaatggttttgagcaccttgtttcgggcgctgaacgacgggttccactggcactgggcagctgcagcacattcaatcgctgcatcaatgtccagcagcgtcgaggccggtgtggctcccagaaactggccggtcgcaggacagtagcactggatcatgtcgggctcctcctgggatcgaagagtaggagggtccatacgaatgcccttccagtggggcaaggcctggtctggggttcgaacgtggatcaccgcaggcttctcggcggcgttcttgtagccgaaaaaccaccgctgggtcgccagaatcagcgtcacggtgacactgattgtggtggaaaccagcagaatgttttcccactgtagagaccccgacgacagcgattgcaggtcgcggaggttaatgtactggtccaggtccaaccaggcctcctcgaccgccgaccatgctgtttcggcgtattccattgcgggggcggatgagacggggggggcgttgataccggtactgtacttggagatgtagcgctgaggtggtggtaaattcaaccttttggtatgcatcgagcacccaactatatgtacctgtggagtggttgagggagttggggaaagaggagagaacggcaaaaacacgttatggaggagaagtcctgcttatattcttgttagagaagaataaccaacactactgccttgtagcagctgaaaacaccacacccatggtgtctccactgtcccttgacgaaagctaaaattgactgacactggtgacggtgaatgttactgtagctactggaagctgtaagctatatagcatagctgtgacgcatgatgtcctactgtaagcgggaatgagaagtgcaaagagataaattgagaggtgattgaccacatggaattgatcaaagtcaagataaagacgacaccatctgattggtgtcattgtgtctctcctgcgactgcgctgcactggctcacaccagctctcaactacgaataccagccctaccataaacatgttaatattaaaacctaagcgttgatgtggacaatgggcttgggggtcagaacctcatctataagcttcttgagcacgtccttctcggccttctcgccagccttcttgatctcggccagctcggacttggcggactcttcggcctcggcctcagccttggtgttgctgccgctgtcggcgttcttggtcttagaaaagtcctcctccttcttcttcttgtaggcctcaatgtcggcagcagcgtccgtcttggcgtccttgagcttctgtgttcggtctgtgttagcacatgcacagggggtgtttggagacagaatcgtctaattcgggcgtatactcacatcctcgtgccttctgcacaatctcgtgggccttcttctctgcctggagcagcttctggatttccttggagttttgggcggactgtgttagcagggtcatggatcgtgcgggagttgtcaggttggtatgttggagtttggttaggcgggggcgtatttgggtcggtccctaacggtatagctcccgaatcagtttgtgtacaagatacaaactcggctcttgattctatcgacagcttgttgcgtcccgtctctctggtgtatcgtcgtcatgtcaacatgctggttcaaacaacgacaacacaacctcgggacttgcagagcaattggcaggtggtcgctgatgcattatctgtaatagctctgctctgagacggtgaaacaatcgctctttttgctttcgtactcaccatttttgtgtgtgatgctgactggagttttggagtctcgacgtcgacgatgatgccagataacaagcacgggcagttgcggcagccgcagttcgagtccctcccacgcacatttaattggacaaataatatctcatctaaagttaaagtttatagttgacttattacttgaaccctccaaccaccccaagataggcttagacctgaaatttgttatcgtatgcatgaactaaaaagattcaccatccagaagaaagaaaaaaaccacacacacacacacacacacacacacacacaaacaacaacacacagcatgagctgctccatctgtcagcaggagagcaaatacagatgcccagcatgttcggcgcgcacgtgttcgctggcatgctcaaagcaacacaaagcctccgagaagtgctcaggactccctgatcccacaaagtacctgaaccgagaggctctctttacagacacatctgttaacagagactaccggtttctcaagcggctggagcgagatattgtagtgcgcaaacaggatggcgaaagcatgccgattttcaagcgggctcgatacaaccagaacagaaaagacggcaaggatggcagtgtgatggagcgaaacggagtcaagatacacaaggtggctcaagggatgggacggcagaagcggaaccatagcagatgggatcctaacatcaagcagttttgttggactgtcgaatgggtgaatgttgacactaacgagaccatgactgtggacaaggtaaaccctgtgcagtcacttctcgagtgtttccagaagagaggcagtgagaagggtgggaatggtgataataagggtgaacggaaggtcgagaagaacgacaccgagcaaacagagatgaaagatgaacattcaaaacagaaggatggcgacaagaaagacgaagaaaaagaagtggtcccgttaacacctagatcattctacatgaagagaatcaagtcgaagaacacatctccaattctgttagatccctcaaagcctctgtctgaaaatctgaaagacaaatctgtcgtggaatatcctaccatctactacaccaacgaagagattgttgcgagtgacagcgatagtgacagtgacagtgattccgacagcgacagtggttccgatgattcggacgattcggacgattcagatgacgactctgatgatgactctgactcagctcctgaagaggagagtgctcgacaaccagagatgcctgacattgtcaaaacattggccgactcagctgtcaacgacatggccggcctagaggacgccttcgaaaaagcacaagaggaaggaaagcaatagcatataatttattgtatatatattttagtagttttggtatgatgtgaacgtctatgcaagtttcagagtgtggataggtacctccgcggtttggctgtccagatcctcgtacttggggatatcggggaaatgtgcaatgaggtcggcaatggagtcatcgttgagcagagaaatctgcttgaaggaccacttctcgcagatgccactgacaaaggccattcgagctttgatgtcacacttgaccacgtttcggacagcttgtcggatctttccaacgttgtcaatggcctttgtgatcatactgtcagactctccctcaccctcttcagcctccttgtcctcgaaaatgtttgtgatctcctttcggatctttcgagccagtccaggggcctttccgtttgtggagatcataatctgcaaagggccatctcggtagatggagccaaagtaaaagtcgcacttggccggcacatcagccacatttacggggatcttgaggctgacggctcgtctccacacctggtctgaaacctcgggatcgtccagacacgacagaacaaggttgtagttgtcctcggcagtcagatggtcatcgttgtacggagccttgatccagataaactccttgagctcacgtcggttctcgagctcggcgtttgtgatagcaggcgacaccacgacgacttccgcgtcagcattgagcagagccaacacccgtccagaggccacttctccgcctccaacaaccagacatcgcttgccccttgcctgccacgccacaatcagtgatcctccaggctgcaccttttcaaacttttgtgtctccgccatcttgtttgtgtgtgttggtgtgcacaagtagccactgtagtgtgtagtgtagatgtcagagcttgatctgatctcgacagtcatatggagatagtgtatctgcatgcatcacgactgaactttgaatattgtattagatcacgtgcctgcgagattacgtacacaacacaattgcagctggaactgaaccgaccaaacaagcccatgtacaagcactgtacctacaggcatcgtaccgattatacgacgccaatgagtcgatttgaaaattctcaaaagcggcttgagccgaggtcggcagtcacatttagagtcccttcaaaaggcccttgaaccgaaaccacaaggtgggcgtgcccgagtcacaaagcatccgtacaatccacagtaatcatttcgagcagcatagcattgcaccatagttgctcttgtttgttcgggtgcgcgagcgatgcatctttctgtcatccttcataatactacaacgatgtacaggtcactgcagtgctgaggatgtgtgttcgaatacgcaaacacgtttggagctacagtatcaacttctagactgattgaagacaatgacagaaacattacttgtacaagtatacgtgacattgtcattgtgcttctgatcacctttttgaggtctatggcagctttatcactaccgcaagacactctagttctcacgatatcaataccatccatatgggtatgtatgtaccgtcctacagctccctacaactccgccatctccgcccctcaccctcaaccgaaagccctatgtggcaacacccacatgggtctcgcatatgccaccgataagccacttccctgcctccactagcgtggtggtagatgtcccgtaaccttgacacatggaaaatgatgcaaaatcacgccttatccaaaccttgaacgtatgtcgatccaaaagccacaggaaactggggtaagtggaggagtgagagtggttatgggcgattggtggggatggtcatttcagcgattcaaggtgtttgggtctttcacacatctggcccattgaaaattaccccactggcctttacagacgtatgtccatgcactcctccaccatgacaactatttcgccgcatcaacagagttgcacaactctggccccagtgtgtggcttgaagaaatacgaaagtgtggagaatcagcactgatctccgccatttccgcggctgaagaagcgtgcgaatgcggagattgaaatacaactttcagtcagtatatatacagacgcgtctccgccaattcaaacacatatcaccctctaccactccgatcggttacatttggcttgcgcatcacgtgccagatcatccaacccatccttctggaaacccacgactcgttatttacacgttttccacaaccaaaatgcctactggacaggagctctacgactcgctgccaaatctgcacttccccgatgagcccaacaccgctgcagaggagattctcaagcgagactttgctggtcaccgaaaggtgagagcggtggtagtcggaggaggccttgcaggaatcaccctgggaaccattctgccccgaaagctcgacaacctggatcttgtcatctacgagcgatggcctgagactggaggtgtgtggcaccgaaacacctaccccggagtcaagtgtgacattccatctcacaattaccagctttcctttgatccaaagaccgactggagtgccacctatgcccccggtcaggagatcaagagttactggcagggcattgagaagaagtacggcgtcgacaagctgatcaagaccaaccacgacatccagagtgccgactgggacgctgagaagggcaagtggattttcaagatcaaggatctcaacaccaacaccgagttcaccgacgaggccgagttcttcatccaggcaaccggtattctcaacaacgcacggtaccctccttaccagcctggctttgacgatttccagggtcccaagttccacccttctcagtggcccaaggacctatctctcaagggcaagcgggtcgcgttgattggtaacggtgcttcaggtgtccagattcttccccagctgcttgcccagggtgtctctcacgttgaccactacgccaagcgaggaacctggatctctcagcacgttttcggaaagcaccttcctccccaccgagagtactctcccgaagagattgcagagctgcgaaacacggaaaagtaccacaagttccgtaaggacctcgagactcgaggccagggaaacattgcctccgacgtctacggatctgagcagaaccgacagcagctcaatgcctttctgctgctcatgtacgagcggcttggcggtgatgaggaactcttcaagaaggttgttcccgactatgctcccggatctcgacgatttctgcctgctcccggctacctggaggctctgactgaccctcgagtttcataccatctgggaaccgtcaagtcgttcaccaagactggtgttgttggtgccgacgacgttgagcgacctacagatatcattgtggcctccaccggatacacccgagccaacggagagtcgcatgcccccaactttgaggtcactggtctcgacggtaccaatctcaaggagcacttttctggagctggctccaagctcggatacaccaacaactactacggaatcacttctccccattttcccaactacttttacgtgctggctcagaactcctatctgttctgcggccctgctcctatcgctgccgagctgtggtccacctacatctccaaggtgatccgaaaggtgcagctggaaaacatcaagtcactggttgtgtccgagaaggctgcgcttggtttctctcgagtagtcaccgagctatccaaggcctcgtctacttctcgaggtatcgatggcttcttcgtcgagaaaaccaaggatggagaatacagaattgcccttgcctggccaggaactatcacccatgccgtaactctgctgcgagagcctcgatgggaggattacgagtacgaatacctggacaacgacaaccccttctccttctttggaaacggacacaccttcctggactttgcccccaagggagacaagaccttcttcgtgcagaccggtgtgcctcccaagctcctccacgaggagtatctgactatccctcgagaccatgttgccgaaggatacgaatatgatggaaccggtgacttcctcaagaaccaccatgtgggactagatgacgacgaagacgtcgagcaggccaaggaggtcagtctctaaacgcaggtttgacaataatttatgtattgaaaagggtatttgtttattaatcgagagtatatacgatactgtgggtgctgcgagtaattgtactcgtaatcaacaccttgtagttctgttctacttgtactgtacaatattggtagaacagcaaatggaagatactacaccctcataacaagacgtggagggacaattgatggagcatgtcctttgctgttgatttcgagctattttgacaaacttcgaagagacaatttcgctcaactaatccccaccctgcagttaagtaaactcttgttgaacattctgagacacggtctctgtcgaaaagttgcaagcaagcacagtgtgggcaactgtaacaacacacgccaatctctacccttccatctgcgtggcggtgctgcggctatcgaataaacctctgcttatcttttttttctatcagggtaacgtcgcatctctcgtctattggggccaaaaggaaatagaacaaatctagtgtggctgaagatttgaggggggatagagctgacacacgtggcgtagacagccaccaggggtgagactgggtggatgagactgggtggatacggttgaaaacgaaaaaagaatgagggcaaacaaccagaccctcatctccgattatgttggaccacatgcatatctgtagaggtcggagagaagaaaaaaaaaaaacagccgatgactcaaatgactcaacactttgcacccaactttttcagcagcgctgcagttcaggaacgcttagagttggcaacagtgtggcaaagataacaagccaccgtggctgaggtgggctgtcagagagagggtggtggtagttttgacattggcaatcacatagaccattttgttattagtgtgatttaattgttgtgttggttgtgggtccgtagctgtggcattatgcgatcttggggttttcgtacgtgcatactcgacattcaagtatcgtgctccagttgcttgttgtcaactccgtttttcttttcttgccctcttccgttttttgtttctcaactgtgattctttttgtctgttggccggttatcgtctcgtccgatccaattatatattccctaaagaaacgaaagcaactctggcttgaagcactatttacggcggtgtcgaattcaagccacagtttctaatcaccctagccccgagggtaccctcataccaccctcataccacgctcccgagaacgccacagtaggcggatttggcggtcccaaactccttctctcctgctgtttcggatgtgtggctttctgtatgagccaatttaatgcccaactggtgctcaagatggacatggtctgcagctctcatgtgtcttatactttgaatgggtaatataattggagagggtgaccgcgaggctccggccctaagcgtgtcttttgacgtctaccacctggttatcacctcacccaccctgtcccggtgacctcccctccaactgtctgacactccaccagaaatcagaacccccgcgtctcagatctagaccgaaccacacactagcaggggcacaagacacctaccagcatccactgctatccagtcgcaccactaatgactatctccaagcctccatcgccaaacaacctcgacaatgccggaatcacctcctccagccaggccggtaggggacataccaacgtgaccggcgtggacaaagaagccctctggaacgagtttgactttctcaaaaacctcgagcctccaagtgaatgggccgaaaccattctcaaccgagagtaccacggccgacggcccgtcaaggtggtcatttcgggcgctgggctgtctggaatcaccaccggtatcctcatcaacggcaaagtggacgatgtcgatctgaccatcctggagcgaaacgaagaggccggaggagtgtggttcaagaacacttacccgggcgtgcgatgcgatgttccctcccactcgtaccaactctccttcgatcccaaaacagactggaagagcgtctatgcctacggagaagacatcaaaaagtactggcagagtcgagctgaaaagtacggcatctcagataagatcaaaacccaacagaacatcctcgaagctaaatgggaccaggaggacggccaatggcacattctggtagaagatctcaccaaaccccatcaggatcagtacacagtcaaggccgacttcttcatctcgtcctcaggaaccctcaaccagcccagataccctcccacacagcccggatacgacaagttcaagggcgaaaagttccacccagtcaattggcccaagggactttctcttgagggcaaacgggtggctttgatcggaaatggagccactggtgtacagctcctcccccagatcgcactccaggctgctcatgttgatcactacaccaaacgaggtgtttggatcggccattctctatatggatctcgagttcctggatacgtggattacacgcaggaagagattgacgagattcaacagtcttccgagtaccacaagttccgaaaacagctggacgaggctcttttgggtaactacggcggctccttctttggaacagaatcctataagggcctcataaaggagctactggcaatcatgtttattcgagtgggtaaggacctggagctgttcaagaaggtggtacctaattacccccctggagcccgacgtcttcttcctgctcccggatatctcgaggctctgactcgagaaaatgtttcttatcatcttggagacattcaggagtttactgaaaagggtatcattggtcctgatggcgtagaacgagaagttgatgtcattattgcctctactggctatgttcgagatgatggagctggagtgacccccaactacgaaatctacggccaggaaggatacactcttcgccagcatttcaaccctcccgaatccaagcttggatattccgcgtgctaccttggactggcagctcctcactttcccaacttcttctacacactgtccgtcaactcttacatttactgtggaacagctccgtttggagtcgagttgcaggccacatacatcgccaaggctattcgaaaggcccagctggaagacatcaagtcgcttgttccctcggtgcgagcctctgtgctcttcaaccgacgaatcaatgagttctccaagacgtcatgtgtgtgtcgaggcattgatggatactacactgagcgagacactgagggcaatgtgcgtctcaagggttcttggcccggaaccatgacccatgctctgagtatgctgcgagagcctcgatgggaagattacgactacgagtacctcaatcctgatgatcccttctcgtactttggatctggaaagacgtggattgatgaccatgatggagacaagactttctacctcaccgagcccggtaaggtgtctgttcgtaacgtccatgagggctgggtgtcattgtctcggcatcatgcccccaactgttctcacaatgctgacgaacatattgaagatggacccaaggccaatgggcatgttaatggtctcaaatcgaaggttaatggggtctagacgcccatgatttgatattttagcaagtatatttgactgatacaagtgcggaagctgctgggcgagtacatactgtacacaagggagcacgttatcagttccgtccgaagagcacgactacaagtaaaactaatagttggtgatcgatactttgaagtaggataaacgctattgtatgtacgatgtacgagggagcacatgatgatggattcggcttatcaccaatcagaactcatcatcctaccaaacaccctatattccggctttgagatattatagacaaccttggttcatgctgaatatatcggactcctcatgttaccagccatctggcccctcgtctacagagttaggcttgtcggatcaagaagaagatgcggaacagatggagccggtgggaaaaagaaacaacgtgacatttcaggttagaacccaggctgttcaatgcgcactaaaccatgatactacatgaaacggcacaccggggatgagatgcacctacagtgcattttcgccacaagtactgtaatgctgatactcctggtagtcgccctaacccctaaccatcccatagaagcagccttgccatccaatgcggcacaccgacgacaggatatctgcaggtctggttctatcgtctttttgtctgtccaaaaaaaaatacgcaaaccgagtattttgtactctaactttttgaggacagggtaacgccaaggcgccagtggagggaggcttggcgacacgtgatgtggacgacagcagcaagggatttgcaagtgtgtagggggctacttggttcaattgaaaaatggatgtcgtcgtctgttgttttttttgcgccaaatcacattcgcctggtctcgtttcagggtcaactaaataagctgtcaccccacttgtgtgcctgttagcaaccaacactaaaagagtgtctccaagacacacgcgcactatcgattcagtagctacagtatatgtatggatccgtactgtacgtacgtagaggcagtgcacacggcggttgtagcaatgacatgatgatacggctcagtcggacatatatagttcaaccgcgcgctgcttggtgcgccctctccaacacacagtacgagtacgatccgatacagcacaatcatattctgttcacaagtatacgccaaaaacatctgcacgtcccactatccccgcagaaaataagtctatcgcgccacaacacttaagtgctgctgtacatcccattgtcatcagacacaccaccctcacaccccacgacctttagaggaagatatttaatgtacaaaaccagagcggccttcgacaccatctcgcccccacaactcgctcccgatggtcccgagcggtcgctcgatctaccgttttattcgctcgccgccaaacaccccggcgtcaagctctcgtaccacgcccgcacggtgctcttttcgtacacgggcaagcagcaggccgacaatgcattgaaatggctcatggacgagcttatcgaggacaatgacgagctggtgtgtctcaaaatcatcgacaaacatagcgccaaggacgtggaaaagtaccacaagcaggcggccgatattttgcgggccgtggtcgcggaggcagacaaggtcggcaaaaagcttaccatcgacgttgagctgggccagggctccgtctccaaggtcgtcaagcactgcacctatctgtaccagcctgctctggctgtggtcgctcgaaccaactacatcgatcctcgagtcagtgaaatgcctaaggataccgccacaaactatctgttgcgttcgtcagtggtgcccgtcattgtggtgcgtccaccaatgatcgacaagtggcaggagcgcaaaaaggcccacgccaacgaccagccgccgttcaccgtgccctggttgattcacgacccccgaatcactgtacccaaggactacgaaacccagcagggcctgttggagaacccctcgttcaaactcgacgacctcaagctgctgcagcattaccagatcgactacaagaagcagcccaccggcacgtcgctccaggttccttctaccgcccccaacagacgcatgtctagcaacgcctcgcaatcgccctccaacatgcgaacgccagcgccagagactctttcggcacccacgtcaccggcccagatgcgcacaaactccgtcggagggggaggcctaccccaccccatgtataaagccgatggattcctacagcttccaccagactccagtgcactcaagaagcagcagcagcgacgtaagtcgaccctgctgttggacgacgagcctcccaagcctccacctaccccggccgaccggtacgacgagaacgcccttgacgactcgtctcccgaaagagacaacagtggctctcaacctccatcttcccgaacgatttccattgtgcatcctgagaaacccgagcgatctcggtctcgaggaaaggacaatttgcggccttctctgtcgctgacccgaacactatccagctcgtccatgtcgtccgactcgtccaagtcgtcccacaagtggggtctgggctggctcaagggtaagagcagcaaaaagaagaagggcggcagcagcggaaacagcctcaagccctccgtcaccaactagttgcatttcccatcttccgactgatacatatatatttattacattctcgatactgtgatttgtagagaggggagggaggcgagagagataccgataaatttgataccaggatgataacaggaatggggaacaatgtcgttgataccggttgcgactagctgtggttggactactgcttttttgtacaactgcccacccattacggtaattcataactcattatatcattaattgatgcatttttgatgcaaggagtctagctacacaactattcaaaagttctaaatataagcagcagtggtgacgctgatgggagtgctgctgggatccttgacaatgattttgacgactcgatcggaggcattgaagaagtactctgcgggtccatagatccagtcgatgagcattcttcggcaccagatggccgagtaaattgctgttcgggccaccttgcctcggttagcatagtcgtctttatcatagcccgctccgtagcacagctgcttgttaaacacgtgcaccacctttctgtcctcgttgtacccgtcaatggtgtatccaacacgggcagcaatctcgtcttcgagttcaggagtcattttggcggactcgacgaaaccaaaagaaacaactcctcggaagagaccgtcgaccccagggactggaacaatcttgactctgtcttcaggctttactcgaggaacagtggcgattctgatagccagcagaacaacgtgttcagagagggtggggaaggagtcgacaaaagttttgaagacgccagggacagtgtttggagatcgaagagtaaaccgcagattattgtagaagatggacattccaggatatcgaggaataggggcggcgttggtggcagcgttgatttcccgatgtcgcacctgcacgtcctttttctctttgacgcccaagtcgagctcagagacattgtcatccgatactgtttcgatggagtcgtcaaagttctgggcgtacttttccttggtgccgaggttcaggctctggatgtgagacggtcgcggcttctttcgctcaaacagacgtctcatgggcactcgatggtcaaactcgtacttcattcgttctccgttaccccatcgccacagcagcatgaccgagatgaagatgactcccatcatgagcgggaaccaggctcctgagggcacttttttcatttctgcagcaacaaatgtcatgtcaagaagaccgaaggagaagagcatcaggattccccacacccagtggtgcttgtgaaccagaacaatggacatggagatcatgacagtggtgatgaaaaagtcgacagccacacacagaccaaaggccgaggcggtgttgttggagttcttgaaaccaatggtggccagaacacagcaaaccagaagaaagtagttgagaatgggcacatacacctttccgtaaatcttctccgaggtatggacaacggggaagttgggcatacagtccagttggatgagttgcttggagatggaaaagactccgagaatgatagactgagaggcaatgattgtggacagcagagcaagcacgaaaatgaaccagtacagacctccgttctggggtcccggaatggtcaggtagaagatgtttttcatcagagaaggctccagcaccattcgagctccctgaccaaagtatgcaagagcacacatggggtagacgagcactagcactgatagacggatggcccagggcgaaaagtgtccgacatcagcaaacatagcttctgttccagtcagacacaggatgacgtttcccatggagtcgatgccgcctgcctttaagtaatcaatggcgtacttggggttggtggccttgagaatggcaggatggtaggtgatgttgtagataccaatgacaccgagggagatgagccagacaaagaggataggagagcagaccatggacaacttggcacttcccaggcgctggaagacaaaaatgaagacaatgatgaaacacgaaatcagcacaacgtgtttttgcatgctgggttgggggatctcgataccttcaatagcagacagaacggactggacaggagtaaggagaccatcagacatgagaaaggaggatcctaggagacatagaaaaagaggcatgattcgcagaaacggagctactgctctccacactttgttgttccacatatcatcggtcttgtgatttccgctggcggcccaagagccttgggtttccgacttttggagctggatgagatcatcttcggggtttgtggacgcacttcctcgctggccgagattcaactcacgagcaattttggcgtagatggccacaatacctccctctccgttgttgggtccaaaggcaaacacaatgatggcatacttgaagagcacgacgatagtgagaccccagaaaatgcagctgacggcgcccatggtctctttctcggtcggatcctcggggaaaatggagttgagcgtatacagaggcgaggtggccaggtctccatagacagctccaagcgaagagaatgccagcattccgagcttcatggctcgcttagtagtcgattctgcaacctggtgggactccacgtccctgtagttgattccgttgatcatttccacaggtacgtcactgtcaagagtcgctctttcgcgttcttcgggagccatgtgtgagatagtgagataaacggcggttgaatgataggcatagtaaggagatcgccattcttatatagactaggtgcgaaatccacaagccattaaccatgggtacaaaagcacatgcttccacatgggcgtatccgtgtttgagacacgaaccgctgattctcgctcgtttggtacgagtagactttctgaggcgaggctgagagtttcagagcgagagctaaacgcgactgcgagaaagtagggatgtgttacgagcggaattttggggcgaatcgaaatctaaaaagataatataatcactatcatgataatttattgacgctcaatttttctcccacatccacccactatccaccaacctgaaccccatactccactcatcttaggtactgttgacatgcacaatgtgcgttaaaaaagcttataaaagccgtgtggtgaaccctattgacgtcatgtaaaaaatgtcacctctgccagcccaaagcttgtgtttgcatctggtcccaacacgaagatcggtttctcctgtggaccatgaagtcgtcgtgataatagttactgagcaaaagtagcttcccatgcgcacggagccgtgtgtttactgcacagcctggatccttgtcgtatcgcaggcagtcattaaagggcccaagactactgtatgtacaggtacagctggatctcaagttcacagtgttcacgccaaggagcgtgtcgaagaagaccagtataacatcacacacagagaaatgcgtagaaaatgacctcggttgttgtacatcaacctcaccagaatcggattttccccatttttttcattttccccatacccttacatcaccaggacaacccggaaaccccagggtatatgtgaaaagggtgggagaaagtcggccacccacgtcttagctgccaaacaaaagcgcccagagcccttatacgagagattaacattctcaatcgtaccaaatgagtgttgaatgagaccagatagcaaaacagtgtgagatgggcgagatatggagatggagaatagaaaaagatgggaaatcatgtatggagaggtgaagttgagattcgtgtttttgatccactgtatgatatatcatgctctcctatactacgaccatacattgcccaccctacagtctgagtggctaatacaacacactctaactgcaagcttagttttctcccttctttttttcacccagccaaaaagagtctgaaagcggaacttgagagcggaagcagttgagagcgggagtctgtctatatctcaaaggtgcattgcatcaggaaaatgtctactgagtttcagacaatgtccctcgttctatgaatccatcatgtgatgcttctgacgcccaatcacgcacaaacaatacatgttactgttttctaataacatctattacatcaatacaagtacatgcttataattaaccatgcagccgctcaaactcctcaagattggtgtacttgtccaccagagcaagctcgtgggtcaaagtctcgtctcggaaggccagacgcacattgggcacgtttgtcttctggatggtgttgccctcggggccatggatctcgtagttttcgccgatccaatgctccttgatgattcgctcaaagccagattgcagtaccgagtttcgagcaagctcacacatatccacgttggaaagcttgtaaatgagcgcagccacagagtactcctcaatcagagcctccttagtgtaagcaaactgcagaggatcatccgatgacaaggacacgttgagaccccgcttgaagtatgagtagaaggggttcttgtcgaacgtgaggaacagcgcattgttggacacaggagacatggcaatggggatctggtccaggtagtaaaggtactgaatgaagggcacctttcgcaacagaataccgtggttgataccctgagcaaccagataagtgcacagaagatgctctgggtcaccagcctctccagcatggggtcgcaactcaaaagtattatagcccaaacgctgtctccaggtgttgatggaggccatgttggcgtatagatagtactgccagtacgagtagggagggttctgtgcgctgtcccagtatgctgcagttgggaactttcggtggaaacgtcggtccagcttcgactcgtcatcgacagagtcaaagcccacaactcgctgcaggaacacgtgcagcttgggatgggtactgggatccttggtgacctcgaaaagaggctcaaagacgttctgcacaatgtcggcaaaggtgttaaccagaccagccttcttgtaaatgtcgtacagtcgaggcacctggatcaaccaccgaacattgggcgaaaacagtttgttgtccagcacccaggcagccagcttgtcccactcgtccttggaccgaccgtagatggaaatacggtactccgccatctggtacttcgagttctcgagatcctggaacacctcctttgtgatctcagctaggtatcgaccctggatgtagttgtcggtctttaggaagatttctcgcagtcgagactcaccgacagggttgtacttgaggttgaacttgtcaaatcgatggaacgagtccttgtgagcatgcatatcaagggtatcgatagacaggtcgtaggcagtcaagttaagtgactcaaacacctgggagagtgtcagctcccgaccgtctcggtggatgacaacttcatcagggcagttcttcatcttgtatttgatgaatcgcagcagatgcttctggttcatgcaggcagagtggtgaacgtgggtgtcgacctttcgtacgttgtaaaagtctcgatgggggttggtcttggactcggttgtctccgtgtactcgttgagcaggtagtagaggttccacttggcttctagatattgcagtcgtcggaaagcaaaagacttggcaggtccgtcagacgaagccacaatgagatcctccagatccatgtagtaatctcggattgaggggatggcaacaaacggcttattttcgttgagagagctttcatcctcatagacctgatagacacaggtaggatctcgcttgaagaccatgtcgttgggtccggggatttcgcagtcctcgaatttgaattcatccattgtcgggtctttcttttggtgctcctttttggacgagcctcggaatcgcttttcggtctcgtgccaggagggtggtggaggctcggggtaaattttccagtgtgtcttgtcatccttggggttgtctccgtccttctgtagcgacacggtttggtacttgtctcggaggtctcggcagtactgcaccttttcgaacatcatggacagctcctgggccacaagaggatcttctgtggtggtggtgattttgacgtcgttgatggacatgttcttcatgtcgtccttggtgcgggtgcgtttgagagtaggagatatgggcttgcaggtgtctttctgggtagcatcatagacaatgtcgtcttccgcagatagtcgggcatcgtcatcgctctcgtagggctcttcttcgagcgatccggtcatgttgagctgctggagacccttgctcagcgaagatccagacttggttctgtttctgttgaacttgcgtccagaagctcgagacgacgatcgagatcgagtggaagatgcgtcatcgtcctctggctgttggtgggtgtggctggagggtgggggaggggggtggttcatttcggcccgcacaaatgacgaagatctggacacgggactctgagagtgctgatgaggcagatggccatgaagagctctgtacttggcatcaacctcgatgaggtggcgttcttccgcgtaagagaagtgggtggacgcagatcggcccagcattcccagttcttcaagctcgtcttcgtcgtcttcgcagcccacgtagccagcaatctcgtctgctccgtgaggtcggggagagatgggacccacaaaatgcgagtccaggtcgtcttcttcgggcatgggcacagacttggccttgcccttgatatccattgcttgctgcggcatggtacagaggcaatgtcgtgatggtgtagtgtggagaggaggtcaagatcaaacgaattagcgggtccttccaacggctctatctccaacatgcacagcaacgtaaacttcatcagggtttaagcgacagtagcgagtgcgatggggtacaagtgctatatggcgcaagtgtttgtggattgagagcactatttatttagggagcttttttgtattctgtagattgatacgttagtcacatgcttgactgcttggtaatgaataccagccccacaagttgttcagggtggagctcagagtctgtcatcaatgcagcactgctccagatgataagctttggagaaaatccgatggaagatggtgatggaacaatggggcgtgtggcgacggcggagttggtatggatggggcaactatgttgaaggttcatagtcagtagcatttccgagttgacaaaagtacaagtagcacagcgagaaggagatacgagtatgtagtctagtgtacttctactgtaatagtaagctgtctagagacagtagctcgcgtcaaagtgaaacccgaccaaggagatgcttcgaaactacaaacaggggtagtcggagaggaggaagggggaaagaggggctaataacctggtggattctgaaaattgagattttttataacgataatataccatgctacattattcagtgcattcactggctactacggacttcagaaaagtgtttcatacacctgcattctcgcttaaatcggacttggcttgaaccttgacaggactagttcctgatcggtgagtggtactttcttggcaccacccagggctactaagtatagatacatgcgacaatgtcttcatttcctgttcatccctttctgtgttcaaaaaaatgatccatagattcatcttgaggaagctatcgagcaggacaagcggcacgattaaactcttatgatttgcgtcaatttaatttcagtatcttcgacagatggatgtggaagtcgaggctattgtatatgagtatcaagctctgtagtccggtgagcgcactactacatgtaattcttctaaaacacgttcttattatattccacctagttctgtaacaagtggcaactaggatcgataccaaagggatgcttgcagacaacctcttccagtattggtgatataccactcatcagtctatcaaactcatgtcttataccaagaaaaagaaaccaaatacttatactctgcaggcctacaagtttacaaatgcaatctcaatatcggactccatggtcctgaatctattacagtaacccagaggttcggattttcgcatactcctctcaaaactagatatacaggtttggatagcccaatcctcctgtggggttcgacttctactccttcagtgaagtctttgcaggcctaggatcaatttctctggctctttgctctgtctgtgtgttctggcattggcacttgttgctcttggacttactggctctttctcagatcaattgcagctcctacagcctggctctgacttattgctcttttgaccctgcaaccgtctgtcgatgctgatttttgctctagcaactcagcactggtggctctggtcatctgctttgctcttcagtatctaggcggctctctcaaaccgggactccaccttcgagtatgaaaaggagtatatcaacagggattctaccctagagtctcccgtcggtaatctggcgacttttttgtccattgctcatggagtgtttcaactcattaacggtcaacctcatggacttgaccctggcacttggggctgtgtccttgtcgtgaaagactgtgcttatcagctcggcattaaaggcaccttccgtcttcagagcgactcatagtgaactggtcttgttctatggaaacccggggtctggagaagatgaatatagttcttgtaaagttcgtcaccttgcaaataaatggcacggcatgctggttcttgtgtatagatacgaaacgaagagaaggacttggaatgaggtggactaaaatattactgtagatggaattgcaagttggaaacgccggttaataactttagataacatcggtccaagtagctctgtaaaaccactttacgggctctagtgttacccgtatatgccacttgatttgcggtcctttgcatgtactcattctttttccatctccccgtcaagatgtctctccaaggagcacaggggaacagcaaaatagtgaacacacgccgcttttctcgaaccgttgacacaaaaacttgcccgatgtttgtcgggtgggaaaatgggggtattctggcccctggcgcccccaaagtcggcatacatgctgtagcgacttttaaacgctcgaagctggttggagactaaacatgatgaaggcagggagagatggaaagaaggagattgagcatcacaatcggcaaaaaaacaattgcagcacccaggattctcgtatggtctcccactacaatactaactgggctctctggtgcttgactatggctgatcggacgggaagccgtattttcaccaggatatggccgcaactagtttcggatgctactaagacgaagctgtttgtatttcggctgaatccgcataaaaataaaaaataaatattaaaaaaaacctcgatacatgtcctacatgttctacacatgttccgagtccgacaagaatactacaaagtggcaactaaaatactacagcttacagttctttttcaattcattagggggtaataatagtatcaactaaccaacttagataagcagggcagcggcggcaacaccggcagcggcaacggagacaccgaaagcagcggcaccgttggcctgggcagggccggtggtgggctcagtagcctgggcgggctgggaaggctcaccggtgggcttgtggcacttgtcatcctcgcaagaggtgatggtgaccagagcggtggactgggcagtgacaacaccggttttggtgaccacggtaccgtttccggcagcggcggcagactcggtcttagagtcctcatcctggtagatgacacgggcagcgaagggagtagcaccctggttgcagtcctcggaggaggtgacggtgtacttgtaagctcggccctgggcagcgcaggcagtgaaggtgtagttggggacgtaaaggtggtcctgaccgtcaacggtgacgccgtcggttccctggccctcgccatcctcaatggtggcgccgttgccgaactggacgggcttgtcgttggcgtagaggacaccatccttcacctcgtaggtggtggggatgccaccgtcaccgccaaggacgagcttcttaccgtcggagacgacgggggagttctggatgtcggagccagatcggatggcgacgatggtgaacttcttggcggagacaagagcggcggcggaggcgaggagaacagcggagaacttcattgttaagcgagtgtggttgtagttggttagagaactgagaagggtagcccgaagggtgttatatatgttttgaaaacggtcccccaacctcagggcacctgacacgcaaggctacaatagcctcagactcagactcagactcagactcagactcagagttcggctcgagtcatggactcgttctcgacgcgtgtggaatgagcttttagacacgaagagagccaataatgccgtgttttgggcatcagattcgggaatcgtatgggtggtatcttgttggatcaccaggggtagttgttttttggctgctctctgcaagcagggacttatcaagcattcccgtgaacatcccgtttcgctccactgcagacatggttttcattagattcatcgccaatgcgcacttaactcaatccccaatgtaacgctgcgggtcgaataaactcccttagtgaggtgaaaaaagctactatcgtaagtgtggagctaaaaataggcaatcacggcgaggccatgatagattggtggaaatcatctccaagtcttgttttcggccctctagcccccaatctagccagaccagaccaggtttcgtgtaattcaggttgcttttgtgtcacagaccttgcgctgaggcctgaaacctcaccttcgctgcccccattcctagatcgacttgtatgtggtcgacatttccaagaatagtgttgtcgcccgtgagcacccaagtagagttgagtgggatttctttttctgatgagttgctcatagatgacatcatattggggacaataatagaacgtataatttagaaagatttagtaaatcaataataggggctgtttatttttggtggcacggcacgacagccagagttcattactgtcacgccgtgtctctatagcgcgcacctgttccccccatcgctgcttctagtgtctatagttgatacccactctaatccagcatcgttcgtccatggacagctccttctataccggtcaacttcacgatctacaagtacggtgaattacagcggctggttgtagttgtctattttgcggaacttgtcggttgagcctgttgttaataaaaaaacaaaacgggtaaaaaactctgctggaatcatcgcttccgcctggttaaggcgtccgattcgagtaactttcgcagtttgttcgtctataaacgcgttgtgggagaagattggaatgcttggcacgaagcaagggccaattgtcaccgttcgcgtctcgaggtgtaggagagcgttctgaggtgggaagaattgcttttgatcaattcccacgccccgaaacagttgacttttcgtctctcgttcgactctcgtttcgactctaggtaccttcttggtccgtctgtcggtcacgccgcgacagtagcgacctcatctgattattcgtccataaggttgcgatcgccatggagatccaaacagtgaggttcgtttcccaaaaagggaagaccgctactgtaagagaaggaagaggctgaagtgccggaatgatgcactcgacatccggggaatcccctgattgagagcaagggccttctaagcgaggtacggtacagtactcgggagagagcaatgttgcatctataggcatagtaaattccggtggctacaagaatgtgcaaatagcaggggttggaccgccgcaactacagtgcctacacgatgtgtgccccttgaaatcattgtcatggcagccacggttgctcttatgagtggagctatgattctatcatgatatcatacctcatacatatgcctcgaacgggcttatgggtattattccaccatcgtcaacgttcctctacatgacccatgtatccattctgtagcgaagacccgatacgttgtctgtctcagtgctttccttgtgcaagctggttccaactattgtagctctcgtttcagaaacaagacacggcaacagggtgctgagacagactaacattctgagacagggcacacgtgatgtgagtgtgagacgaactggaatgagagtgtggaatggataactgggttgttcgagttttcacgcgataagatatcattgctgaagtaatgtacataccagcgccgctctggtaccagtgacgaagtaccgacagtgtagtatcgtacatacaggcgtacatacagacgctcgtaagcgtcgtatgtcaccagacgtgctttgataggatcatcactgtcatgttcgcacctgtaatcagttgccctgtcgggctctgtgtgtatatagaagtctttcagtagaacgcgttgcttgttgttgagtgtcagcaggtgtactgatggtgagaagccactcacaagtaccggtacaactagctacgggtgtcactaggagtacgagtacaagtacaagtaccgcaggccatcccccaacgacattccggatgacataatatgatggtacagtatgtacttgtatacttgttcaagtgcaagtccatatatagaccccattctgccctcccaaatgtcaaacactgttcaacaccttgttgagcttttggtgaggcacgcccatccgtacttttaccaaccaaggtttcagtttgttttgatgtaagggttgccaggcaacgcgtcacaagactgcctccccaaacattatgtccacgtgaccaacgtcccgatcaaactcgacagacacttgcgaaccaatcgtcgcacccgcaccgtgctcgcacaccaagacaagggacctacattctgctccccaaccgggtctttccccaacagctcgtggccatcagcttgctttttcccgcacattcgatgcactccaacgggttctgcatctgtcaacggtctatggtaaaagccgtattctcgcaccaagggaggggaataaaatagacccgcggtccacagctaacataaatgcacttgtgcacactatataaaccctcttccggcactattttccttcagctgtaacctcggcttcaacccgtgaacactccaatatcgaaggccacaacgtgcctgaaaacttaaccctggaaggtggtagctgctactcgtactcaaacctgagagagggagctataagctccatgggtggcgatgcaagggcagggtgggggaagatgcaaacggtttcgagacaagatgcaagccacgtgacaagaaaccacgcccaacccagctcccataccagtattcgtactcctacaagtagctgtctaactccaactccccctatacttgtaggcacttgtttactttagctagacgcattccttccaggaagcttatttgtgcagaccccgtgcacctctgcaaacctttgttttgatttacgaactaattcttcccacgactctgttcttttgcccacggtgattttcaggaccccgtttggatcgcacgcaaccacggctctcacctcacgcccccgtccggtccgcaactaatcgccgccaccaaagcccgccacactgcacgtgccattgtgtcccagaaatcagacgcgtcatggacagctacgaatatctgactgagggtgagtaacgaccagaaggacgtgtttccagacacaaaaagaaagggaggttccccgggttcagccactaacacaggtttcgaccccaagtctctgcgaatcgcagacctgcgacgaatcttcgcacaccacgacattgagtacaacgtctccggcaagaaggccgagatgatcagtgtcttcagaaacgaaatctctccgcgcgcagcagagctctatgccagggaaatcgccacccctggaggcgagggcattgtcgacgccggagcccctaagatcaagagcaagaaggaagggaaggagaagaaggagaagaaagaggacaaggaaaagaccacgcgagcgcccgcaaaacgacgggttacctcgcgaaacaagacccccgaacttcaggctcccgacgagatccaggttagacggtcgcccagacgatctccttccaagcaggatatttctcttgatctggacgaggttctagcctcccccaagaagaagaaggcgtctctagattcccccaagaagaaggttggccgaccacgaaagatcaaggagccctctcctgaacccgagtctgaggaggaagaagaggctgaggagattattgagcaggttaagactacacgaaagctggagctggacgatatccccgtcattgctgctcccaagcagcaacgacaaccgtccggatacgctgtggatgacgatgaggtggttgagatggatgaacaggaagtcgctgagttgattgcccccatcgtagaccagtcgccaaaaaagtcgccaaagaagaacaagcggcggctgtcacagcccgtggtcgaccctgaacggtccgacaatgaagatgcccggccgaaaaagaaaaagctgtccaaggaggaaaaggaggctaaggcgctgcgaaaggaaaagaagcgaaaggaaaaagaggctctggcccgaaaggtgttctcctttgaggacgccgagactgccgagagcaagctgctgggcgaagaggacgaggttgccgactttgagtacaagaaggtcgacactcctctcaaggtcaagaaggaggaggactcagcagactctcccttcacgtctcagaacgttttccagtctggaggaacccccgacaagaagagaaagcgaaagtccgaagtggccgaaaacagtgctcgaaaggtccgaaaggccgaggaggacgacgacttcaatgcctcacttgaccagacctttgcctctgttcctgaagccttttctggtcttggaggggctgcacagattccctctttgtcccctcctgcgtcgttcttctcacatcaacaacagccaactactgccacttctcagactccttcgtcttcgacgcagttttcttctcctccccattccacctccaactctcgaatcaaccggttcatgttctcttcccccgaggagcgagatgacgagaacgtgaatgtggtgagctccacccctcccttgcctgtggcctcttcttcccaaaacacccgccagtcgttcatgcctggtttggacgagctcaacctaagcagcaagtttgctgaggagctccgaaagcaaaaggaagaagagctcaatgacgacgacgacgaggaagaggaggttgatgtcaagtccaagggcaaggagacaacgagtatcaccaagaccaagacaaaaaacaagcctgtggttttcaaggccaagaagccgtccgtcttgtccaagattgacttcaaggctgtcattttcaaccttctcaagcttgtgacaattggtgctctcatctctggtctcgtgatagctggtggctggtatcgaaaggagaagtttgccgttggatactgtggcaccggtgagcatgcccaggctctatcaaagtatgacgagttcattgaattctggaaggaggttcttcctccctgcacaccttgtcccgaaaatgccgagtgctatcggggctttgagctcgagtgccacgagggctttgttgctgaggctcaccctctctctttcaacggcttcctgcctctcccccccaagtgtgtctacgatacccgaattgtttctgttgcccagcaggtgctcgactacttgcggctgcagaactcctacgccgagtgcggctctcccgagtctgaggccaccggcttcgacgtccaggtgaagaccgagtttacctacgacgaactgtacgactatggacgaaagaacgtgcatgcctttgacgacaaggtgtgggcacaggccatgaaggccgtcggtgagcaggaagatattattgtaaggtttgtttgtgttgaagacggaaatgaggaactattactaacccagatcggatcaattcgtatcagtgaatcccaaagagcaacgcgattggttgaaggagaaccggaagtctactacgaggacgtcgtggttgcacaggagacgtacaagtcaatctccgacgcctacttcactctccgatgcaagtgcgacaagtttgttcgaggatggctggctcaaaatcagttctatattctcggggttttgattgccgcttccgctgctattgttggaaaggaatggtataaccagcgaaagcgagagcagcagcatgtgtctgagcttgtcaatcaggtcaacgaaatgatgatgacccaggcacgggaacatgacgctgactctactggccttaaacaaccccgattccttcctgtgccccaacttagagacgagctgctggtagacaccgccacttccaagcgaaaggcttcgctgtggaagaaggtggctgacaccgttgagcagaacgccaacgtggagtctcagaccaaggaggtccgaggagaggttacccgagtgtgggagtgggttggaaatttgaactagttgacagtgtgtattattattaataggtgtggatatagaaaataactgaaatgtgtatttaaatttccgaaattagaagccaaggcgtatattagttggtgggaaccagtgtacgaccgggtcctgtataaccaggttcagtggcatacttgtaggagttgttcccgtggtatttgggcatggctaagacatttcgccgaccaatgttaagtgcacaatagccgatgtagtagatgtaagccagatggttttggagcaggtcgattcgagaccacagattgaaagtgcctcgatggcaggcctcgttttctcctccttcacagacagacactttgtcgagtgcagggtagacgctttcttggtcaatgtacacttctccaatggcgtgtgtgtaattggaccaatctggcagtccaacgaagatatcgttccagtgggtgagcctgtagtttcgtcgcttgtcgtttacttcaaggcctgtgtcattaaaccacagctggttgatgtagtttgcaaactctgagtttcctactctcggctggccaaagttgatcatggtaggatcatgtccaagtaatttgaagtgagttgcgaaaagaagagcttgagcagcgcccagcgagtgaccagtaacatacattttgtagtcagtgtggttggtgaggaacttttcaaactgaggagcagcattgaccatagtttcgttgaaggccttggcgaacccatcatggatcatgcagcctttgcactcactagttttgatgggaataagacgggggtcttcaaccaccagagcccgctctttgaggttgtcaagacctttgttctccacttccaagtctggtcggactgcccatctctgtttcatatcgtcttgggtagggatcaggtgcttaggaagctcgaccaaccacggagactgttgaaactggatgtcggtaacagcatctggaatgctgaatgttcctcgaataacaacatatttctccttgttgaggtgatcataagctatgtatccggtgattgaagtggaatagaagtctcctccgaagactgagtccaacgtcatgttcgggaaataccgacaactctctccacatgtaaaatcagttcgtagaggagtgactggcgcattgacacagtaggcgatgtttgcaatccgagaaaacttggccgtaaagttgtacagctcctgggaggcttgaactcgagtttttgaaagtgtcgctggtggctcgccgaagagggaggcatagaggtacgcaaccacttgcccgagcgtgaggttcatgatgccaatagtgaatgtcatttatcaccgtactgcgcagtatttatatagggctcatcggtccatgtatagatctgtccacttatgacacccccatgtctcattaatgtgtaaaggtggagacgggtggagtacaggtacagagttggaggaaatcaggatagtggggttaagacatgctccgagtccaaatttcaactctccattgtcacaagacctctggtttcagagttattacagatctaggcctgtttcaaggtgaggggacctcatctggatcggcacgacgatcgtcaccttacagaggacgtctgtcgcagggaaaggtgatgtgcattaattaatcatttagatgatgagagggcatcggtttctagagggcatcaggtacaggaacgataacttgagatctgacaggactccttgaaaggtgtcataaagtcggtcgtcaattgcttggtatgtttctggactgatgatgtttatgtttactgtcgtcgcggacaaggcgcaagaaaacaaaacaattccagtaaatttgcttcgtataagtcacccaaaaggacactaaacttcaccgaatcgacagggccaaggtctcttgaatagtccgcgcgtacgtttggacgcagctgaactgcaccccacaatgtcataaagggacacaaggattaaacgtagaggcgcccagcgacgttacccttgcaatgccgctgccaccgttaaccccggaagaattgatgcgtctttgggcttccttgttagtagcctgtgtggtcctactaaggcattgtgttcaatatacgactatttttaccgacgccgcataagactgggagtacacccggttcaatatatgagataatttgtatgtagatggtcctaatcacccccacagaagtatcttcacatgccaatagagcggaaatagaaaactccgttggcacattatcagacgtccactttgggccaatgtcttacaactcaccgtgtaggtttaaaagcaggaaccgcggggttggcagccaactacaactacgtattgacttcatgtgattctccctcttttggatgtggaatatacattgtcgagtagataggctgatctgtagatctgaggggaaaagagacttgtagtgaactacgaatatcatcgagtagttgcacctttttccttattggtggtttggtatccagacccaccaaggtacaagtatgtacccatatggtacttgaaatggcgcatccaatgtctcagaagacaaggtgctgtacaattacgaggtgcatctcacttgtatcgtatgtactcgtatatattcaggcttataccacggaggtaagatatcatgtactggtagaccggctattgttgctgcatcaatgtttctttctccgagacatcacacgctatgaactgaacagtatgtactgattgtcagctacggacgtgattgggtgacagatgtcctggaagctattcaactaggataatatgagagatgtgaatgacatgacaaccaggtacgagtacatacccatacaacaagtgtgcacaccgggataccttacatgaccatgagataatgaaggcggaatgtagcataactaagcagatcatctcagttagagtgcactgtgcggatctaaaacacttttcaacctccttacaccccactctaccctgtctcattactccaaagatcgacatgaaagacagttgacaacgtcgatccccccacaatatggctactcaaccatctttgcgaagatactgtgattctacgagtacttgtacgaggatgtggtgtacagtatcgtactacaagtagggtcaatgtccccaagtccgtgtttgcaactttgtaggagctgcaataatagtacagtatgtactgtacagtaacaatgagctattttttataataaagaataacaatcaatttttttttttgcataaactttttatataatgtaataatcacttctaacaaacgcaccaagtaggagatgtaggcttgtcaagtaattacttatttactcaagttagacacagttcatctatacactatcagtgttttcgatagacatttactttcgccggtccaatggaaataccatcgaactgatcaaaggctctctatatccttggttccttggttctccactctcgtagctaccttcagtgtacagcattatctcaaccccaccccacatacctccgataacgtgcaccgaaacctaatccaatttgtactcttcgctaaaacaagtctctgtaacacgccttcaacacactcaccagcttgctacacaaatatcgctagataccaccgacccattcattcgatcagtgagataccaccgtgatacaagttgatacattggtagactccgctgtcatggacaatgctacgatgacatcgtatcgatccgcgattgatcataaccattacgggcagcctgaaacgatacctctgggcgtgctacaaccctccagcaacaggctcaactgcaagactgccgagtctgtatacaaaacgaaaccgcagctcaactcggctcctatcaaccaaccctcgcttacctcgactcgatgggacggaagtgcagtcatgaccacggcgcagaagatgacgagcccccagtacgtgacctatggtgacggagtggaccccgtagatctatcaacgaacttcaccagtatggacaacgaccccgggcctacaagcatctgtatggtcaagccgtctgatttgcgccaaacaagtgtctccaagtcgatcatggagcagtaccgtagccagattcgacgggaaaaagaagcagtcgaagaacaggactactccaccataagaagcgtcacgtttcaccctgtggaagacttgcgaatctacgagcctctaactggagagcattcggagaacacgttcttcccgtctccgggatcgggatccaaggtccccagacgacttgaaaatggtgcggccagaatggagcaacagggctcgcatctcgaaaactccctgttcctgagcaagatgtaccgctcgcctaccccgttggaatcatattcgcctgttcacatgctagagtatggggggagcatccatttgggtgacagtggctggggtccttacggcaacaagaaaagctacactatgaagagcactgcttccatgccacgttatatgaaggataccatttcctatcgaaacaagaagcgttccaagcacgacacccagaatggaactgagaaaggcaccagaaagggtcaggaccgtgactccgctaaaggggtgggtagaaaggccaagcgtgatttattggattttttccggagataacacgtcctatgtagacagggtaaatatgacttggtcgagagaaacagttacgcggaaggggttggtggttggggttgggtgtagtgggtatttgtgagggggtgagattgttgggcagacaatgatattgccgttgtagactttcttcaattatacatggagcttggaacatcgattgcctgtgatctctcaactacggaaatgcagataacgattacaatggcacttgatacccatatggtatcattgtatgagtattttgacatgtacgtaattctgacatggacaaagatcgacttttccaacaccatatgtagaacctcatactacacactcagttctgcactcattcaatctaatcaaaccatctattatcctacatgctaatccttcttgagctgcaactgcttgacctgctcctcgaggtttcggatggatccgttgagggcgatgacgtcggcaatgatcacgttgttggcttgtcggtactggtccaccaggtaggagtaagcgccgaagccggtgagggtggtgccgagcaggaatccgagcagagttcctcgcacgctggacttctttcggggcttgagcttctgggcagaagagccgatggtagctccggcctgggcagccttagcagtggcctgggcaccggtggaggctccctgagcagcggacgacacgttggaggcagcgttggaggcagcgttggcggcgttgttggcagcgttgttcacggtgttggcagcgttgttggcagtgttggcagcggcgttctcaacagcagcggtcttggcctgggcagagtagttggcggcaggctggatcttggtgggggcgggaggcacagcgacggggtggggagcggtagagtaggctcgggtggcgggtcgggccactcgggtagatcgggcgatggttcggatcattgtgtgattttttgtgtatctcgtctcgtcagactcctgttctgtctcgggcttctttcactttgctaatgtgctgtgggatgttcgactttgagttttcccgtttgggatctgccctaaccacacgaatggcgtcctgtgattgggtggatgtttgtagaatgacggggatcatatttctcgacgccaaagctgctcaattggagagctattgagaggaatagatatgacttaacttgattggggctcgttgtagctatagtggtgctttaagaagctgtgtttcagggttgtactgcctcccaaatgctgaataagcctatgagtgatttgccatgttatagcggctacgagccggtgtagagtgcgtataatcacgtgacccactagatagatacattttcataattaatgatcatttaatcacttgtctgtcggttttttttggtcccaggtatctacgacttagctcttgtatcctactgtagttgcgtcgacgcactggtgttagttactgtagaagaagattaaagtaaaaaatcaagtacagttgaagtacaataccgaaaatactcgggctcggacatactgcacaactgtaccatcactgtagcaagggataatatctcatgcatttcggtcaagttgttcgtatacatacatgattagtaatatctaaaaacgtccttctcctctcccccctaaataatacccgtctctcttagctgggcagacaagaccatgtctgtcacggcggccatgacaaaacgcatgttctcagtgtccgtggcacaggtaaagtggacgtaaatctctttggacggtccgcacttattttgggccagaaagagattcttaaagaaagccttaaccgcagtgacttcatttggtccattgaaactagggaagtatttgcgaacaggcgatttctttagcttggcctccaacagatcgcatttgttgagaaacagaatgatcggcttgtcgatgaacgttttgaagttgcagatgtagtcaaacaggcagatggagtcctgcattcggttcacgccagagtcctcatacagaacctggtcgtactccgacagtgcaaccacaaacagcacactggttacgtcatcgaagcagtgcatccacttcttacgctcgcttttttgacctcctacgtcaataatgctgagcatctggccgcccaccagaaaaggggtttccgaaacacctgtggttttgattcttccccggatgacatcctcgtctgaggccaggtaataagggtcggcaagactgtgcacattgtcaaagtagtatgacgccgcatcttccagctgatactcgtttgagcgggcaaaacattgcttaattcctgtatctttagtccatagctctgaaatggcgtgtgcaatctgtggccgctcggctggcgacaccttgaggacattgtcggcaaacttgagcggcgagtctgtataaaccatgggaagattctcaccctccataaacctcctttggcttttgatgtcttcataaagcgcatcccagtcaggcatagcggagtcgttggggtctgcattggtgagcagggtcatatgactgttcagaacgctgtgtggatcgtcgcaatccaaagaaatgcccaagaaccgtgcctggcgcacaatttccatcatctggacgaaagcctgctcccacataacctgagcatacagactgcgttcctgatgggtgaagccctggccgtggatgagcttcatttgtttgagaatggtcgacttgccagactcgccggtacccagaagcagtagcttggggggtttggagtcgtcaaacgatctggagctgcttagttttccgactctaaatcgcatattctcttcaatcagtagatgctggtcatgttcagccccgtactcgggtttcgaaggtacacatcccattgttcgggtggtaggggcgttcagataattaagtggtcgcggatggcttgagatgtgttggaggaagttgaggggggttacagcgccataattatatgttgagccgaagactccattcactctgcctcattgatatcctctttgggatgtggggctgaatgaagtgctggtggatgcacttgccgggggttccctcgattggaggtggtcaggtgacgagaagaggatcaaacatgtgattttaagtgacacaatacggtccggctacatattcagtggctaccaaacccaccatatagtagttgcggccgtagggtattgtcatcgtggttcaaccgtcagtgcaagaacatgcacccccccacctgcactcatgcaccttctgccacatagagaactctatcctgagaacttggagtcatacttcaacacatctattccatgatatactgtaatacttttctaactaaaacttgatgacaaaagctccctcaatgtcctcctcatcctcgtcgccctcttcttcttcttcctcgtcgccttcttcctcgtcgtctgagtcgtcattgtcctggtcgtgatcgagcttggccttctttttgccctcatgctccagatctcgaagttctcgtttgtactcatccagctcctcctggctgccctctaggcgggccacagcatcgtcaagatggcccttgtactcgtcggcttcaagctgggcagcctcgaccttctccatggcctcgtcgtagttctcctgattgctatcaacctcctcctgctggtccggaatcacctcctccagcccctgaatttggtccttgagatacagagcatgttgctcccggtcgtgtttggacatctgtggtagaaccggtctcgtctcgttcgtgcattcaggcaactacacctttggaggttttaattgctcccgccacgttcctctatcgttaaccgggctctcacaccatcaatcggctttatacggatctatgctgccgctatacgaaggcctaaaacctataccaccactgtgctacctgtagttgtgcccataccggtacaccctccgctagctacaatgctgcaccagtaggtctcttgggtcgcatgtgacgtcatggcgcagtggagtagtggtagtgaggatgtcatatgtttcacggacttgtatcaacctccataccaatcacgctcacgtctataacccactcagtaaacgctacagtaacttgtcatcgccttctgacatgccccaatgccaagtcccacctcacaaacggcacccaaaacagccccaaaacagccccaaaacagccccaaaacagccccaaaacagcctctaataaagaccactctaaaatagtatatgctgcttgctgctgttgggtgagctagccgagccgccgagtgtcatcctggcatgtcatgagggataaacggaaacagctacttggacacgcaatgggcctgggggggttttattattcctccgcttacataatcgtccattgctcattgctccgaaagaacagatcgaaccttgattacacgcatacatatgaaggcacaacgtttctgacgtacaatatctgcttcttgatcactccttcacacaaagaaacatcaaaaaaacaatgcccaaggtcatctctaagaacgaatcgcaactggtcgctgaggctgctgccgctgagatcattcgactccagaacgagtcaattgctgccactggagctttccatgttgccgtatctggaggctctctggtgtctgctctccgaaagggtctggtcaacaactcggagaccaagttccccaagtggaagattttcttctccgacgaacggctggtcaagctggacgatgccgactccaactacggtctcctcaagaaggatctgctcgatcacatccccaaggatcagcaaccacaggtcttcaccgtcaaggagtctcttctgaacgactctgatgccgtctccaaggactaccaggagcagattgtcaagaatgtgcctctcaacggccagggagtgcctgttttcgatctcattctgctcggatgcggtcctgatggccacacttgctcgctgttccctggacacgctctgctcaaggaggagaccaagtttgtcgccaccattgaggactctcccaagcctcctcctcgacgaatcaccatcactttccccgttctcaaggctgccaaggccatcgctttcgtcgccgagggagccggaaaggcccctgtcctcaagcagatcttcgaggagcccgagcccactcttccctctgccattgtcaacaaggtcgctaccggacccgttttctggtttgtttccgactctgccgttgagggcgtcaacctctccaagatctagatgtattgaatggatgagtatgatagaaccagtaaggtaaatgtgagccgttgactcgaaatggcttgcttgtagagatctgatagatataattaagccattgacgagtatgacgttgtattcatctgaagttgtattcatctgaagtagctacacaatcttgctattctttacactcataattcattattttatatacagtcatttcgtcggttatttgtcgtaggtatttgtcgtttgctcgtttcgttattatcgtagtttattcatagcatgtatcgtcaggtcgtgttgtgttgtagttgtagttgtagtattggtcgtgtatcatatcgatcttcattcatcaagagtaccgagggcagcataaagcgaatcaacgtcaacttttccattcctggtgcgcagcatgctcacaagagtgccgagagaagagttggcaaatcgggcatggccactgagaatgttgtaggcgtctgtacagggcaccaggacgggagaagaggactcagcacagggcctggcagaagttttcaacacagtgcaaaagaggttagccttggggtccttagcacacagacaggacgacagatcttcttcggtgaccgagacctctgccatctcgttggccacttggtcgacggcgtggtctgtaatctcaatgacttccggcttgtctggcttgagggcactagagcagggcttttcagctccctcctcttcgtcaagaccagcacagagacaaggagtgccgttggaacagaacccacagggatccacctgaggggagggtttatctacaaagttgctgtccacaggactgttgagactagagatggacggtgttcgcgagatcttggcgacttgggtctttgaatgtttgcaatcgggaccatggacgtgtacaggctcaggaacaggtggagtcgtgggtttggagccaaaagtctttgtaaaatcgatttcgttggcttcagacacgcgcttgaaccgctttcggattatcatagacgtcccatttgaggcagggcgcttcttgaggggaacagcagcaacaggcttgatttcactgagattgacgccgccaacaatgtacgtgttttggtcctcagctggaagaggtgccttgagtcccagggtatcacagagacaatttcctccagtctcacacagtccacagtcgtcgggttcctcgtccggtttcattggcgtgatatcatggtggttatgttgatgttgatggtgatgatggccagtgctgttattcgcagtttgggcacctggggtatcgtcagcaatggtgatgaccgattctcgtcgttttcggggcggtcgggctttggggaggatagctactggtttcttttcgttttcgttttccttgtccaagttgctcttgcgttccttctccatctctctctgttgccgtgctcgttctgacatgggaaacatggaacttctaacagccagcgggttggcgtcgacgaagccgtacagagattcgcgcgagtcctgggttttgagtgcccgtagcatttccacctcgcttcgcagctcttcaatcacggctctgagtttgttgttctcggtgttggagttttgaagcgccgcacgtaagtcattttccacctcgtcgtgttcctgttccacctcctgcagtttgtcctccagctccacgacccgggctgctcgtctttctcgaaacgctcgctgagcagctctgttctgggctttgcgtttggttggcggtaggtcgttggacggctttcggccgggtttcggccgcggaggaagtacccattccttggaggtgacaatgttagtgatctccggcgacacgccgatggagtacgacatggacgagttctgcgagagcatgcccatgtccaggtcgtcctccattttcacatggcgcggcttgagcgcagataccggcggaggagatgaggacgacgaagacgagcctagccggggaagtggtcggggctgaagcaccggaggcggtccgttgctctggatctgtggctgcgacgcctgcggtgtttgtgccacgggcttgagggccagcttcggcggtgccgactgctgggttggaggagctatcggccgagaaggagcctgctcgtttgagcgcagctgcgggtgaatggccagctgtggaagcgcatgatgcggtccgtgggacggtcgcaccggttgcggctctatcgaccgtattggcgtcatggcagcgggtgtgaaagagtgttgaggtcgtggtcgataacactggtgttctacgctaaaccaaactgaaaaatcctattgtgcgtattgtgggatgcacgggtgaaaaaaaaacacaaaattcagacgacccagaatgtgactatgcactgcacactatataaatttactctctaccaagtacagctagtagggatactcggacggccgcccacaatacaggagaaagacacgttgcgggatatttcggatagtcgttttagcgttgattatgcactcagatggtggggtggagggggttgttgatcgatcgaggagccaatgtggccgtctagtgtttcagcatggtgcggcggtcatgagatgtcgagcgtacaacagcacattgcgctcatggttgctcaccaccggaccaagtttttcgcttctttttgccaccttgctgttgtcttgcttttgcggtatatttgcttagacggatcgggtggaaaagacgacgctgagaaccaagagatggaggtgcagctgacacgcatgtagattatctaaaccatctgccaatgggaagggcacgggagagcccgggccgaccagagacagaaagagagatagccagcaaaagaagcaagtcagcaactgcgtaaagagacgtttcagtttcagaactcagtagggttcgagaccatgataagctttagataaagcgagcaagaaataacaccgagatgaggccaggctacaaaaactcgtttataagttggctacttgtagagaattaagcaatgatacaataaaaatacatcagttgcacttgcgaagaccattcacattgatccagcaggaaggaccataggaagggcccgcggtgacaatatgaggatcgccagtggcatgtatgttctgttcagccagaccaatgcggtagtcctcagggtcaaagtacacataggcggctcggaagaagggaagacccattacaagacggttatcggtcttgctgttcagcgaaggtgcaatcaacagtcgacatttgtcgtctgaatgctgctccaccggcatcatcagggctttggctggcacgtcgacagagacgccgttgaaatcaaaagtatacttgaagttgctagcaggaacattgcaatccatttgataatcagcgaatccttcttgttgaatattctgagctccaaagtctgcttggatgacgtcaaaaacatgccgaggaacagtaatcaaggtgtaacccgtgtcaaaatgggcatcaaaggtctccacacatttgggacgagatccgggacgtctgaggatgtcctttccatttcgcatgatagaagtgatgagtgtatcgtattcgtagggcttgggggagtccttgattcggttgagtcggttgttgaccatcttggtgaacctgagctcacccttgattcggtcctggtcatagcctccaaaaagcacttctgctctttggtttgcatcaatgtagacaccgaaggaccgtcgccgaatgattccctgacttcgcatctgagagagaagattggggtatctgggattcaccatctctccttcctcaagacccaagcccatgaatcctgtctgagggcgatgtctgggatgggtaggatgggggtactctgccactccaatgttagcgtcactgatgattcctccagcaataattagtctctccttggccatgaagccatcaaactttctaccatccgcgtactccagatgcataggaacggaggtgttgacatacgaggccgaggactcgggtttgaagccagtggagagaggattgaaccaagtttcggaagagccggtatcaacctcgattgacacttgtacggcgggatttcccacggaaatgttgagcattagaaactggaaatcctcatactccccagcagctcggaggtagttggctgacgctagagatagagaagtcagagttgacaggaagaaggtggatttcatggctgatgatgatctgatggcgtctgtttccttctcatcctttccaaaaccccatctatatacatttctgtgtctgttggtgtggtatcatctgctgtggttgtgctattgaggtcgccaaaacgggtagcatcaattgggtgcccaaaagaggtggctcaatgcagaaatgtcgctatctgaaacacatccttggcagtccgaatcaagacttaaacaggtgacattctatgtggaaaaatatttggtcattcttcctcatggccaagggcataacattggtcagcattccttacttccatacacatctaactttttgaccgttgagccttgttacgcgctgatggactaagcgaccctgagcactcgggtctagcaacaagtagagtggcaggggctaggctgaaacattttaaccagaaatgaagctgattcgagagcaaccaggcttcagaagaccatcttgtgaacacctctcgccctccacgctctctccataaacctccagcctgcgcccccacttttgggttccataaatggtcccaaggtttcaggcgctgtgcagagtgggtgccaaataacggtgtgtgtaaaaaacgtcaaatacaataacggcttccaagtttctcacttttcagcatgaaacgagacaagaacaaaacggacggcgacacggactccacggactccacccccgacgacacaaccgccacggacgacatgacggacgacgtacacgacctgtacgccactgacgccacctccccacaggtggatggtgatgtcgatcagagcgacgtcaagacgcctggagacacagtgacgcaggagagagacacagacgcgggctcagacacggagacggagtccgacaacgacgcggagccgctgttatcgccctcacaaccccacaacgtgcacaagtacagaggcgtgctgcactgcggagtgtgtagtaaggtggtgaagcatggcgtccaggtacgacctctaccgtgcaaggaccacgtaatacacactgagtgtgtaacgggaaacaaccagctgccctccaagtgcatgtctcagaaatgctcgccgtcttcaaacacgtctacatcttctgatgcctcgcccaatatggctctgcccaaggtaattctcaccgtccaggactttgaacgagactatcccgtcacacattttctgcccacagaaagcgaagtcacctactgcctggtgtgccagggcatcgtcaacccgcccacacaggtgcggaccatgccctgtggccataaagcacatgccagttgcatcccagctccactggccgtacccgataagtgcaggttctgccgacgagataaccattatagaagggaacaggagctgctggacggatatgacccggcgctatacgccaaccaaaacctgcctgtttatcctggcagatcagacgagggagaagatgatgactcgcctcctcctgctcactccccgccgccccctggagcagaactggggctaccgacgtacgaggaggccaccgagtggacagaagagacaaaatgatagacagatagcatatacgtgagttgatttatttatagcaagattttggggccaaaaggtagcatttttgagcaaaaaatgcaaaaaaaagaaatggcgacaattgcaggactcgaacctacgcgcggaaaccgcatttgatagctgaatagaaattcaagtcaaactccttaaaccactcggacaaattgccagtttttccaaattttaaaaagttcattatatcaccgatagacagggtcacgtgactaagtttttttttacaggccactaaaactgatgaggacgatgggttatctggtttgtagaaaagttagggattggggtgacaatcaagtctatgataagtatttgcttggccatctctgacgctcgagaggcttgtttttatggctgttgctcatgttccgttttgatgatctgataaataggggtgatgatcggcagagggtcccttcaggggtaagacgtgcgctggtggtggtcataccataggggtaaggaagtaagtatgtgggtgattggcaaaaaaaaaaacaagaaaaagtggctcggatgagagctctaacagctttcagtctccactcaaaaatgtacacattgttccccaccaaatccacttcctgttgtacattcctcatcaatacgactggcctgttccagtccaaagttagatctgaaacgatcagggtattcagacataattagttgtgcttaaaagtattcatagtagcatcctcaaaacggcgcagttctccgagaatacatgtatctacacatgacgcgactctcgttcatcataagattgatatcgctgtgttcacgatacgtctcctgtattgctttgcaacccctaaacgctgggacgcatcgatacggcacaatatgcagtggttgcttcaagcaaacttggcttggtaggtgtggtgaatataccggtatcgaataccagtgctgtaggatgtatgtgtttgcgagcctgccatgtcatacagtaataaccgtagagtatttgtatacagtagctagttcgagatctgtttgagaagttgtctaagtgttgtactcgtacaagtgctgattgtgatttgcactgacgactgacgagagacactctcgttttactcgtatcgtaaagctgcgacaaatgcggaagaatgaacatgtgtcattttagcccggcgcaattgtgggtgcctgcggcgttttcagcttgtatttcgggctaaaacagggctacaagagattctcggaggccccatctctgtgttttcgacacttgtggtggcaacatcaaaatcacgttctcaaaatatactgtattgtactgtcaaagtatgacaagaggggcgggtgatgcctctatggttgcggttacccggccgtcatcacgcaccgtaccaccaacactgtgcaggacctcccaacccttgcagaggttgggtgtggctatatttacatgcagacagatagacaacagaagcttgacaagtgagagctgcaaatacttgtacgaccacccgacttctttgatacatttccaccctcacccactcactctcacgccaacacagtcgcaaatggagtggttcaagaacatttacgaatggctcttgtcgctgttctggtccacggagctggacattacgcttctgggtctccagaacgccggcaaaacgtcgcttctcaaggccatctgtggttcagatttcactccagactcgatacccactgtggggtttgctatgaagcgggtcaaggtgggccgcgtgacgctcaagtgctgggatctgggcggccagccgcgattcagaagcatgtgggagcgatactgccggggagtcaacgcggtggtgttcatcctggactctgcggacccgtcgacgttcgataccgccaaaacagagctgcattcactgctggaaaaggaaagcatggagggaattccgctgttggtgctgggcaacaagaacgacattgccgacgcaattccggtagacaaggtgatccagacgctgggactcaaggaaatcaccgaccgcgaggtctcgtgctactccatttccgtcaaggaggccaacaatctgagcgccgtgctaaagtggctcattgccaacagaaagacctaacagcattcattatttatagacaagcatgtgacaagtacccacaacgatgggcgtagagaatgcgcacgcacacatgggcataggttgaccgataagacctagaacaagaacctcaatatccaagcaggtggattcaacgtgactgcaatcttcaggagattccgtaagcaacctgcgtgactatttgtacttgtagtagagctatcataagtagcgtcttgtgctctcataataagcacagaaaaaaactacttgttcatgtatatattcacgtcttaatttgactaaatactagatgcattctgatagttgatatcgttagtaggcgcgttgagcgtttttgtttttggttggttgaagggggcgacatttagatgcgaatgtcttattattagtgtggggtgtgttgaaggtgttgactgaggcgcgtaggtaccattaactctggaatcgttacgcggcgactgctagaatgatgatgagggcgaggatcatgattccaaggacaatcagagaacaagttcttcgctttttctggtaatcgttggccttgacgagctctccagcagctgcggaggtctgatccgccaccgtggagatgttgttctccacagagtccatctgttctccctggtgggctattaacgcaccgaggtctctgtagatgccgttaatgtcgttgatgccctgttcgatgccccgaatgtcctcctctcgctcagcaatgagcacctgttgcaggtccacctccgactggtccaccacgtccagcagctggtcctgcagtcctccgtagttggtgttgttcatgcccatgggcttggctgccagcaggcggtcctgttcgctccgttcttcctccagggccgctcgggctgcagtatcctgcctcttgtacgcatcggtactctgatgctgcaggttttggaaccggctcaggagcaggccgaactcgttgctcagccgtttctgggcaaactgctccgtgttggacagctccgcctcgggaaacatgttgagccggcgcacgttggcatgcatggttttgatgtcggcggtgattttctccgccagatcggtgacacggccacggttggtatctccatcttttcgggttccgatccacgacacaaaccggtcgagtttcgccacgtcggccgagatggtctgcagcgaatcggacagctccgtggtcacctgctggaacggcactttctggttttcgagatccatgctgtcgggcggtgttttggggggttggttggaggtgtaggagtcaaaaaaaaataatttattagcttactccaggccagaggtgactaatagaggttaatggaaactctcagtcaagggtgtgagtgtgggctgtaggtgggttatgataaatgggagtggcagaaggagcagccaaacgtctcgtgaaaaaggagaaagaagaaaagggactcgcaaaagtggggtatccactacaaacatgaaccctcctcccgtacaagtgagaagaccatcacaaagtgtcttactccctcctccacgtgacagcgattgacgccaagccacagttggatattgactcgggtaagaaaagtggaaaatcaagggacctcctatacattacatttatacaagtatgtacatactgtacagtaataggagaatagtgcacaaccatagaccacgagtcatggccgttgcaagagggcggattgaagctttctttatattggcgtcgcgtgacacattttttgaccctagagaatgctccactcccggcatccctacaagaggcgtattcgtttcgctacgtgaatgagtcgcaacgagccgcagccgagtggcacacactatattaaggaacgccacgacgggggctggctgtaccttcagtagctagtggagatgggtgcaatggaaaagacgtactcgtaggaaaacggaaaacggaaaacggaaaacggaaaacggaaaacggaaaacggaaaacggaaaaccacggtatctatagcaggacacacgggtcaggagatgtcgactcatttgattagtcattctaatgcgatactgggatagtctgcaagtgtcgtctcgtacatactggtcgtatgactgtacccctcgtgcccctcgattcatcttctcatgcagatgagacatcataattagtccgtgtaattactctatgtactggtacgatacattgtcatactacaagtgctactggttacaagtacttagtgtactcgtactcggaccggtgaatgccgacattacgcacgagctccgatcggatatacagaaacgaccgagaaccacagtgcataccgcaactactttatgtacagccttgtagactatggtcggtgtccgaaaaccgccttttgaagccaccatgacaaagccacgatggcaaagccacctgcaagccacagagggcggatcagccacagagggtggatcagctatagaggactgagaatcatcagtgttaagtccgtcgcacaactatccgacatctcttgactttgacttaaatctccatgtactggtaccagtccacatctgcgctctttctgcgatgaatataaagcggcgaagctgtctgacaagtgaactctggtaaactctggggattctatacgacgtgcatcgatgccgtgtacttggcagaggctatataagataagaggggtctcggtgggctgattctgagtatcgcaatatcaccagcatgaccttccaggacgcaaaggacatctacaacaaccgtctgcaaaagtcaattgaggaggtggacaagtatttccccggaagccacaaacccctgcccgatactatcccttccaacgtcagaccactgctcaagctgctccatgacgaagactacgaggttgtgacgctaggaggaatcgaactgctcgataaactggccaagggcgaatggtctgccgttcgagtcacgggtgcgtacattcgagctgccgtgttggcccacaagctggtcaactgcgcgaccgaattccttgcagagcgggcctacaaccgagccaagttccttgatgaacatctggcccaaaaggggcccgttggacccttccacggcttgcctttctccgtcaaagagctgctgggcgtcaagggacatatctccacctgtgaaaactccttctttctggactcggagcccatggaaaaggatctggtgctgatccagcagctggagagccaggggggtaccatatttgtgcgaacaaacggcccgcagctctgtaattctctcgacagttactctcctgtccacggttccactctcaacccttacaatacttctctgaccactggaggctcttcttccggagaaggagctctggcggcctttggagcgagtatcattggtctgggaaccgacattggaggctccattcgagctccttcttctttctgtggaatctacggtctcaagcccaccaggggacgcctttcgatgctcaattgtgtggggtccaacccaggaaacgacttcatcaaggccgttgtaggtcccatgtctcgagacctgcgtctgattgatttgttcatggagaatatcatcaagcaaaagccgtggaaggacgatgtttccttggaggctgtgccttgggagattgtgtcttccatccagcccaagaagctgactctgggatacaccacctttgacggggtggcccatcctcatccccctattgtacatgcaattgaagagctggtcaagaagaacgatggaaagactgtggacggagtggaaatcactttcaagaagtacacccctgtcattcctgaagatattatccacatgctcattggaatgttcatgcccgacgctggagagcgaatcaaaaagtggtccgagaagtttggagagcccttggatgaccctggcccggaggtcaaggctctggccaagaagctggaaattagcgatgtctttgccctcaacaccaagcgagacaagtatagacagaccgtgtgggaggactggaagaagcaggggatcgatgcggtgatttatcctgtatacatttcgccctcgtctgtgatccgaacacccaattatggattgtacaccatgctgtggaacgtggtggactacccgggagtgactcttcctctaaccaagatggacgccaagaaggactacggtcctactcctgagcctgccaatgacatggacaagaagttcctgggcatgtacgagccggagaagttcgacaatgctcccattggagttcagattatcggccctcggtttgaggagcctctgctgctcaaggtggctcagcttctccagggcactgttcagcctttgggcgagtaggtattttgaccacaattgatgttattgaacaggaacttttcacaagtagtgattactgtagcgacaggtacatactgtgatacagtgacagatgtgtttgagagtcggcactgtagtcagatcactatgtacactacgtagtagaactatcacgaccatgccagtactaccataaatgtttttttattttatttgattttacagtgatcaatagatggtcttcaagagcatgtaaagcctgtaattacaagtaaaccaccaccagagactgtcacggcctaggaacggctccgttggcaacaagcaaagttcacacgacgtaggaggtgagcaatcacctcttcgacacggtttcaggtaggggcttcaaaatgagaagaaaaaaactgagagcgaaaaaagaatcaatatcatcccaaatcccacaacaatgccaccccgcccacggcacatggcacggtacagcacccaccagcacttctacacagtacagtgtgtgcatttggatgcgatgtgtctcctaccacgcgtattagactttttcaaaaacaatttgcagcttaatttgcaacctggtcatgcaccttttcgagagggggccaaaaagaagtaagcccaatatgcgacggcggcaactctgtggaataataaaaattcacacacaagtatgtttgctgatttctaagccgtttgtgtctttgtcttctcaattgctcaccttgttcaccctttatcaaagggctcagtctccgactgcacccccaaccccgaactctaacacgcgtcggggctggtaacgcgttttttcaccttgatgcgtctcaattaggctcttttgggttatcaaattgagacccgtcttttactcttaacacattacacactagacacattacacagcatgtcgcgacgaaacgctctggcggccctcaaggcggctcgagccggtgagaagcgagaactcaccttcaacgccgaagacgtgtacgacgagctcgacgaaaccgagttcaagcagcaccgaaaacaagagctgctccaggacgactttgtggtgggagataacggagaggggtacgcagacacgggcgcgtacgagtgggaggatacgggcaagcggtacggctccagcgacgaggacggctcgcccaagagcaagcgggccaagaaaaacagcgacgtgatcaagaaccgcaagctcaacttcaaggcgctggcgtccaagcctgtcaagacggagacggcggcgtcagcagtggcagacgacttcatggacgacttgattggcgtgattggcggctccgggcccaaaagcgccgacaagaagaaacccatgaaccgcaagtcgcgatccgcccgggccaaggaggaggaagacgtgtttgtggacatggactacagctacgacatggccagtccggagcacgtttcgtcttctccccccgcggagattgtgcatgctgtcagagaagaggccattgctgacggcatggattttgctgatgacatggacattgatatgggcgagcccgacattcctaacaaagtgcctcaatcggagtcagacgacgatgaggacgaggttgtggttcgacccaaggccggccaggctgcagctgcagtcaacatgcgcggccagaagccggtggttgcagtcaagaaggagattgtcaagacggagccagtcaagaaggagctggtaaaggaggacatcgaagagcccgaactggttcccgatatcaccagtaacatccagcttgcgacttcaaaggctggatctgctgatactgccaagatctctgtggagcccaacgaggtgaccaccgaggacggcaagttcaagttcttctggatggaacacgccattgtgcgagacacactctatctgtttggaaagaccatggtgctgaccggcaagaacaagggccagtttgtatcgtgtctcatcaaggttgcaagcacccaacgacagatgtttgtgctgcccaaaaacgagtgtagcacttctgacgtgcacgaggagctcgatggaattatggaggcccgaggtattcgaatgcgagccaagcctgtcactaaaaagtactgtttccatctgcctggtgtccctgccgaggccgagtacctggaggtgctgtactcccctcccaaggagaagttcgacgttccttcttctggagctaccttctcccacgtgtttggagccaatcagtcgctgtttgagcagtttgtgctctctcatcaggtcatgggtccatgctggatgcagattgatgagcctgacttcgcctcggctggtcagggacgtatttcgcacaccggaatcgagatcaccgctaagtcgtcggccaagatttctgtctgttccaaccaggaagctcccatgcctccaatttcgatgatctctctggctgtgcgaaccatgaccgagggcaagtctcagtctgtggtagccgtgactctccgaatgttccaggacatgcctcacgataccacatccaagctcggcgagctgcagcaccgatctatgaccttcttccggtaccccagtaaggttgcacctgttggcttcaagcagattctgcaggaacacaatgctggcactgctgtggacaagatcattccatgcaattctgaactggacattttgagccatatggtgcggcttattgcgcgtgttgaccccgatctcatctgcggccatcgtctggaagctctgcatctggatgttctgctgcaccgactcaaggagctcaatgtcaaggactggtcttccatgggccgacttcgacgaacacaatggccccacatgaactacggagttcttgacggccggcttattctcgatatggacaactcttacggtcggtctgtggtgcaaggatgtcagtcgttcgatctgactgaaatgtcgctcaacactctgggcatcaagcggatggacattgagctagatgctgctcatagcaagatggtcagctctgcccggcctttgcttagctatctcatgcactgcatccaggacacgggccttgttgccggcattgtgatccagacccaggccattcctctgtccaagcagctcaccaacctggccggaaacgcctggaacaagactctggctggtacccgatctggccgaaacgagtccattctcttgcacgagttcactcgtcagggctacattattcccgacaaggaagccggtcgaggcaccaacaagcgaggcaaggccaaattccagggaggtctggttctggaccccgttaagggcctgtacgaccgccacgtgctcgtcatggacttcaactcactgtacccttccattattcaggagtacaacatttgcttctcgactgtggactgggcgtctatccccgacgaccagattgagcctcctgctcagcccgaaccctccgtggagcagggcattctccctcgactcattaggactcttgtgcagcgaagacgggaggtcaagcgactcatcaaggaccccaaggcgtctgctgcccagaagaagcagtgggacgtgaagcagatggcgctcaagctgactgccaactccatgtacggttgtctgggttttgagggctctcgtttctacgccaagcctctggccaacctcaccacctccatcggtcgagacactcttcgagccaccaaggagcttgccgaggccgagtccctgcaggttgtctacggtgacactgattctgtcatgatcaacaccaacacagacacctacaaggacgccatcaaggttggtaacgacttcaagaagaaggtcaacggtctttacaagcagcttgagattgatatcgacggtgtttttgctcgtcttctgctcaccaacaagaagaagtacgctgctcgtctggctactgaggagggcatgggaaagattgaggtcaagggtctggatctgagacgacgagagacgtgccagatttccaaggacgcttgtacctatgtgttggagcaagttctgggtcccgacgaccaggagactgcgctgaacaatgtccacgaatacctttttgagctggctgagaagctacgatctgggcccgtcaaggacgagtcagctcctttccccgtggagcactatgcgattctcaagcagctcggaaaggaccctaaggcctacaaccctcccatccagccttttgtggctgtggctcttcgacgtttggagcgaggagaggtgattcgagagggcgacgttatgtcgtttgtcatcaccactgtgggctccgacgagtctgccaaggcccagaccactatggatgtcaagctttctcgaggcaagcttcagccggatgccgagtactacatttccaaacagctgtaccctcagatcgagcgactcctcgctcatgtgaccggtactgatcctgtccgacttggagaggtgcttggcatcgagatcaagaaggcccaccagtcccacgagtcccgagagctgctccatccgctggagtctaccatctccgatgctgagcggttcaaggatgcggttaagctggagctgacttgtgagtgtggccactcttttgcctacgagggagtcaagcagaacaccaccgagcacggtattatctgtccctcttgctccacaatgttccctctcacacggctgtgtgcccagttggagacatcaattcgacgacacatttccaagtactacgagacttggtacacgtgttcagattccgcctgtggtattcgaaccgcccagctgaccaactttggaaagcgatgcatgggttccgatggccgcttcaacacttgcaatcggggcactctggactatgagtacaacgatcaggacctgtaccgacaactgttgtacttcgacactctgttcaacatggacaaagcagctcaggaaaatgataaggatatgaagctggctgttctggccggtcagaaccgggagcggttcgtgtaccctcgccaggtggtggacaagtatctcaaggactctggacgagcctttgtggatatggctgcaattttcggttaatgtggaggagatatttatgtatactaatggacttattgattatgactgttgtattgtagtttggtatgaataattgtgcgtgtactagtacttgtagaggtatttgtctgggttcatggggtattggctaatgcagtacagcacgagcacgagtacaacaaattatcataccgtactcgcttgtacttgtacgtaccgtgcaggattgtcctagctaattaggtagacttcacaacgaagtatcgtaactatgaacacacagaattagttgacatacaaccaaagtggtgctttttacagccaaatgtgctctattaccaataaaatcagaagcgggatatttttggtttccattacaatacagactctcccattgacccagtctacggtcatcctccctcacgttttcagctggtcaccagttaaagttcggaggtttgtgtggtcccaacctatcgtgccctaaccccgagttgggagggccaatcaccgtgggtcaatatctgcacatactactggaatttctgaacagtgatcaagcacggaacgacaaaagagtgagtattgagaaggatgaaagcgttacgggaaacgaagtggatgtggtgctaagatgaagcgacgatacacgacatgatgtaacgggaagaaacgactcgtgatcgatacatgacggcggaggagttatgttgtcatggagcatcacgaaccatgggagatgggtcggaacggcaaagacgaagtgaatggtggattgtggaaggtgttaatgatcgattatcggttggtgtcagagtgcccaagttgtttaaacacaacatttgttttactgatcaatgtgagaatgcaagggaaagactacaataactacggagacatgcaactttggcataattgatgggctgttgttgtttttgattgttgttgcatatggagagagctatttcttgctgtttatcactgtagctcattcgtttctccacttgtcttgctcacttctccgaaacacctgattcatgtgcatcagacacctttcatgacctgttctagatgtgcgtatacaaacagttcacatgtctttgatacatatgctcaccttctcaccctccaatgggtcctgcttgtagggttgttcgtgatctttaactacttatccattttcatactaacccagtgtctgaacacgttcaccttccctcgccgacattcaacaccagctctgctggccactttcacccctacaacaccctgggactggccacccagagcgccatggttggtcttggtgctggtgtcgttgccgccgccgcgcgaaacagtttagccacaggcccccgaaacatcctgaccaccttctctaagtctggaggagtcgtcaccatcttcaccggcgcgtctatcgcctacgtgttcacttactgctctgctgccaacctgcgagagcgaaaggacggctggaaccacatgtgggccggtgctgccaccggtgccgtacttggagccagaactaagctagtccccgcatttatcggctggacggtgctttgcggagctgcctgcggtctgtttggctggaccggcgcccgattcaacgccgaccgaaaggcttctctggagcagtctcccaagggcttcgttcaggaggatgctcaccaaactttctgggaggttgtccaccgacgacccttgtccctgaccgtggagcagcttggtgagggccgaggaattaacgccgtgcccattgccactgccaccgaggcccccaactagcataatagatgattgagtaacgctgagaaagagattcgcgtaatagagacgcacgagacccatgaaggctattggtttggggtgtagtataagagacaagctgtcaacagagaacatagtgattgaacagagaccatatcgtatacaacttcagcatgggtcatgttgagagagagagtacaactactcgtagcttcatagttctcaggttgaagagcaaaatctacggtgtaataaataaaagctgacgttcatttcgagttaaggagaacaaacctggcattgtacccccaccaaatggctaatagtgttgtggatattgcggggcgcatacagtagctcgttctgaaagagccgtcgttaatgccggctgtgccacctcaacaattggacgcccgagtgagtgagagtggcggtcatcagatataatatagaatacagaacaagtacggtataagtaggtacgagtgtcgtattgtgtgcatcgttagcttcttacaatgttcagattttatccataaactcttctctcttcttcgaccctgcctcagaacatactgtagctgataacctaataaccgaggcgagtccatcttgacctccgcaacaacacaatatgacttcacggtacagagtggagtactcactgaagcagcaccgacgagatgaattcatcgagtgggtgaagactctgcttgctacaccctttgttcttcatgcaggatctacaggtgacggtcgtcctggagacgaaaaccgatctgtggtggaaactcgacgacgatacgctgagatcttctacgatgtggaaaagctgattgaaaaccagctgtatcatgacaacaatgacagtggagagcgggctcgactgcgacagctggtgcctaccattggccaattcttcaccaagctgcctctggaacgggccttctacacccaggacgagatccggtcgatttctcacagacgttttgtgtctccaagcttcaatgacgtgcggatgattctcaatactgcacaagtcatggcactagctacaggtcgtcagccactcaaactggtcacctttgacggagatgttacactatatgcagatggaggtaacattgaccctgacagccctatcatccccgtgctactcgggctgctgcgaaacgacgtgtatgttggaattgtcacggctgccggatactccgagaaggacggttcaaagtacggagtccgtctctatggtcttctcgaagcgattgtcaagactgacaccctgaccgaacaacagaagaaccatttgctggtaatgggaggcgagtccaactttctgttcaagttcattgctgccgaaaaccgattcgaatggatcgatcctgaagagtggactcttcctgaggttcgaacttggtcgcaggaagatatcaccagtgttttgaacataggcgagcgggtgtttaccaatgccctcaccaaatgcagtttgcctgccaccatcattcgaaaggtgcgaggagtgggtatcgttcctcttccaggcaagaagattatgcgagaacaacttgaggagatggttctggctgcccagaagacccttgagacatccaaggcgactggaaacgtgcaattctgcgcctttaacggcggctccgacgtctgggtcgatatcggagacaaagatctgggtgttcgatcccttcaggcctacttgggcaacatcacaggcactcagactctccatgtgggcgatcaatttgctgcccttggcgccaacgacttcaaggcccgtcttgctgcaaccaccgtctggattgccaatccttccgaaacggtggagatcattgctgaactcattgactacattgagcacgagcgacagtgcagtgcttgataacaatggtgaaagcaccacggtacacataatagaaacttattcaattaaataacacatgtatataccctccgggtagttcattaaatacgttaatataaatactgctatgtttacaactccagctgcatcttcagcttgattttgaatccgtctttggggtacggaaccacaaaattcgacgtcagaaagaattgaacgataggaatgtcctccttgtgatactcaatgtaccgtttctcgtcgtctggagccagcgactcttcatctgccaccagattagcgtaaaacagatcatcgatcagcatcttgattctgtctccgtaaatgtctaccagatcctcgtactcgccctccgtgattttcgtactcttcttgagatacgagtcggcaatgagacgtgccaatgttcccttgatgaacctcagaccactggagatatcgtttcctgacaactgactctgttctttcaactgagcctgaagaagctccttctcgtagttggggcctttgcgacttctttcacgcgtctccctcaacttggcctgaagcatttctgtcagttttttatgttcctgtttgagattcctttcagcacggatgcttttcctaagttgtttggcctccttctcaagcgcattttccagcgaaatgttgttgttaatgctgtcttccacggccttgccggcaaacagaaacgacaatgtaccaacatcttccttgtcaatgccttcaatatgcctcagtgccttttcgagacccacataacgtttctggagagcggtcaaagggtcgtcttccctcaagggcgtcgcctcggctgaccccccctcatcttcctcttcgtccgagaacccaaagtcatcgccatgctttttcggcatcggcttagccgttttgagagcttcacattggcgagtcagcttttgcagcaatggccgggtcctctctgaatgatactcgtcgggaacagtgtcgagaaactcgtccagctcctgtccttcagacccgaatacgccactcaacgtcgtgtccgtgcgtgtttcccactcgtagcttttttgtacacatcgtgccaaagctgcctttcgtgacatgtttcggatagtcgtgtcacttcaccaagggatctatgttacgcgtcgtgcatgaacctgcaggtcataatctgtgatacaacaaatgaagaagggttacggagtatcaatggtgtggcgtatataagtcagaaatacacattgttgttataaataaatatcgtattgtacatactagaaataattattgcctctgagactctcgagaggatcatgtttcttgggaggaggggcagaaggagccttatcgggaacatgtagcttcatatcttgaacgcaagcccactcctttgaagaaggtccaaactccttggttaacgctgtaatgagcactctcagtttttcttcgagtacctcctttgagttattttgtgccagtgtttctgcgttcaggggtcccttgacactcgtctttttgacaccgtcagtctccttttccttttccttttccttttccttttccttttccttttccttttccttttccttttccttttccttcttgttcgttttcgtcttctttctgttcttttcaaacagagaccctcccatgagctcttcattgcgggcattgaagtcttgatccttgctgaacgtgtgttccaaaatagtagcaaactccacggccgaagtagccttgttgccgagattctcagcctccaagcgccacttgaacggcagtcgcatcacaaccacattgtacacgtcctggatatcaatgaatcctccagtgccagcttccccgtaaagacacttgttgatttctcgctcagattgggctctgctgacaagacgagccacgtacgaaagataccgcttgagtccaccccgtttcgaaactgccacgttttcaagcaacgacattgtgtgagaaacgaactcctcgtcgtccttgatggcagcaaactcgctgaccacaaaccgtctgatttcgcgccacgagcctgccaacacccgttggtgcatttccttggcgtcatcctcaatctccagcttgtctaggccttccacctcaaacgttctgtatccaaactcggcttccagactgtagatgactcctagagacacaaagaatgggaggtaataaacaagataaaactccaggttctccacatcatgatctccgttccatgcagcaaatatcgctcggatgatcgcctcgtactcccagataaaagtacgcatatctgtagctcctacccacttcatgaggttggacgtctcactcaactgctcggatgtgaagggaatgtgtagcttgttgggatctgcgggaaacggcgcctcgtcgttgtcgagcttgaccattgaaaaggtcttctccagctggtcttcgtggataattatcgtcttgccaagaatagcctctccatccgaggcagaatgcatgctggagttgcgatctggacccataagatccggaacgtcatttccgctcgccttgatcgagttggtgagttcctccatctcctgctgcgtcaactcgccctcctcatcgcctgactgtatcgtctcatccatttcttcaatcttgccgttggagtgctccaccagcacctccagagccgatgaaagcgatcgtttttccatcgggttgagctggttgaacacgtcccacacctgttccatggtgatctctcccatgtccgggaacccctgttttttcagtatctcgtccatcgtcgttcgtgtcagtggtgttttttgttcgtggttaattagaattttccaatatttgatctgagttacgcaccgacagatgaggaagggctacagtaatttcaacactgatagtttgatactagccaatttaatgagagaatttaataaaccattcactgcaccagtcgtcagttttagtacaagaaaccaacaaagagctgttcatctggcccataagttcgccggtacatacaataggataccattggagtttttctctcaaacacatatgctctataaaacattgtgatattcctagatctgtttcatcaactattttcttcatttatctttttatgcgttcaccaaattacaagcgctatacttagctttagttatagagctccgcttttgttgggagtttagtttaattataaaccaccacttcataacaatcgacataagtatgatacagtactcagacaaactacttattcacctcacctctcacctctcacctctcaccctcatgatcatgatcatttgttgcaaacttgcaacatatctgagaaccccctgaacccgagagaagcaccactttcaaacctaggctaccgactccttgtaatggcgtcgtatcgacgtgatacagttccccctccacctatttgatgctgatcgtgccgtgtgggagctacaggtaaccatctagttggagctactgtaggtcgtctggcgacgcctggatgagcaacatgaatcacagaaacacaccacaagccgagccaaacatcaactggagcaatattagcactgctaccggtgtgcatctactgtgctatatacttacaatgactacaatacaagtaccacggtacattacaccaacacaacgtctcgttttaacaaccccaacaagacacactcaaaccatgataagatgtccgttcatcgtaagttgggtggaggaggttgcaccagtacaaataagaggaaggtgtcacaatgtcgaaatttcaaactgtcgtattgtgtcacacgtgaccccgtgaccccgtaaccccgtgaccccccacgtgaccccatgtccaactttcgactctgtgtttcaccagtggccgtttttgtatcttacggcggggttccgtccttgcagcctgagatgcgtcttacaacctaacctgccatacaacctgccatacaacctacttttaccccacattttcggactaggagtatatatacttttggtcttgttcctgttgctcaattccccctctccatcgtcttcttcgactcaaataaccccccttgatgccccaaatcattcacaaatctgcctggggcgatatccctctatccacctttttctacggaaacgtgacggactatctccggagtaaaaagtcgtttggatccgacaaaatcggctacattgacgcagagacgggcgagggaatcacctacaaacagctgtggaaattggccaatggaatctcggccgtattgtaccatcactatggtatcggacacgccagagctcctgtagcttcggatcatactctcggagacgtggtgatgctgcatgctccaaactcgcggttcttcccctccttgcactatggaatgctcgatatgggatgcactatcacctctgcaagcgtgtcttatgatgtagctgatctggctcatcaattgcgagtcacggacgctagtcttgtcctgtgctaccaggaaaaagaaaacaacgtgcgacaagcaatcaaagaagcccaaaaagatgctgccttcccgggaatcacccatccagtgagaattctgctcattgagaatctactcacaatggcctgcaatatttcggaagaaaagatcaactcggccatggccagaaagttcgaatactcgccccaagaatgcaccaagcgaattgcctacttgtcaatgtcgtcaggaaccaccggtggtatccccaaggctgtaagactcacccatttcaacatgtcgagctgtgatactctaggaaccctgtctactccttccttttctacgggagatgatattcgagtagcagctatcgttccaatgacccatcagtatggtctgacgaagttcattttcaacatgtgttcatctcatgctactactgttgttcatcgccaattcgatctggtcaaactactcgagtcccagaagaagtacaaactcaacagactcatgctggtgcctcctgtgattgtcaagatggccaaagatccggccgtggagccttacattccctccttgtatgaacatgtcgacttcataactacaggagccgcccctcttcctggatctgccgtcacaaacctgctgactcgaatcacaggcaaccctcaaggcattcggcactctcagtctggcagacctccactgaccatctctcagggttatggtctcacagagacttcccctctatgtgctgtgttcgatccccttgatcctgacgttgatttccgatctgctggaaaagctacctctcatgtcgagatccgaatagtatctgaagacggagttgaccagcctcagctcaaactcgacgacttgtcccacctggacggcatgttgaaacgagatgagcctctgcctgtgggagaggtgcttattaggggccccatgattatggacggatatcacaagaatcgtcagtcttcagaggagtcttttgaccggtcgcaggaggaccccaaaacactcattcattggcaagacaagtggctcaagactggagatatcggtatggtcgaccaaaagggcagactcatgatagtggaccggaacaaggagatgatcaaatccatgtccaaacaggtggctccggctgaactggaatctttattgctgaaccacgaccaggtcattgattgtgccgtcattggagtcaactcagaagctaaggctacagagagtgcccgtgccttcttggtactgaaggacccatcttatgatgctgtaaagatcaaggcttggttggacggtcaagtgccctcgtataaacgactctacggaggagtggttgtgctaaagaacgaacagatcccaaagaatccctctggaaagatcctgagacgaattctgagaaccagaaaggacgatttcattcagggcattgatgtgagtaagttgtaaactgttaatggacatttagctaaaaaactacaagtattataattgtacaagtagaatgaactcgtagtgtgttataatgtagaagcgatcaaaaccaacccactgacccatacttagacatatttacattatttacatactattcgccaccttcggacaaaagaactagacgctcgatggaagccagatgcttgccgtaactgtacttcttcaacgacgccagatgaggcttaatgatgctcaccaaaagatcgaaatcctctccctcgctgacatccagcagcttttggatcacgtagttggcaaactgatccttcatcatgacggtaatggggagagtgccatcctcccgctcggtggcaatctcttcaatcagagcccgacgctgccgtcggttaccgtagatgacacacttctccacaacgttggacgcaaacttgtgtcgcgagaagatgagcacgtgctgcttaatcaccagcatcatggcctccttatcgtcaggagcgccctgctccaacacatgctgaatcacatagtttccatattggtcctggatcaagtggtaggcgtagttgtgcagctcggccagaatggccgcctgggcctcttcacagtgctcgagcattcgctgaatgactcggcaaccgtaaggatgtgtggccagctggtacacctgctcgttgaacgcgttgataataaactgaatgtgctgagggggaatcttctcaatggccttttggatcacatggtttccgttctggtccttgacacatcgcagcacatgcttatctagctcattgatcaggtgcgcctgtttggcagtgtcgacgtactcaatggccttctggacgacacggcagccatacatctgcagcgacaggctgagcacgtgaccctccatctgcttggttagaacagccttttgggcgttgctaccgtgcacaaagaacttctggaccacatagttgccaaacacgtcggtcataagctgcagagaagaaggacggatttcctcgaaaatcgcgcttttctcctcaccgctggcagactcgagctgctgctggatgaaccgagatccatgctggtcaccactgaactccacgatatggccctggaggtccttgagctcgaacttcttggacttgttgtttcggaactcttcaagcaggggagatcggtagccatctcgctttcgtcgcgacgatgacgagggaggagcgctggcagcactgttggtgtctcgggactcaactcggggaggagtaggggtggttggcaccgcggtggttgcaggaacagaagcaatgtcagcctcaggtgcagcaaccacactggctttattagtaggggtgcgcgtagtgacgggcttcgcgacaatctgctcaggagagcccttcttcttggatacttcgacttcgtcgtccaagccgttggggaagaactccttgacgccgtacttgcggggtgagggtctgcctcggaagccataaaagtcgtggccgttggaaacagcggctgtgggagcctgtggcgactgcgtgagtccggccatgccgggcatgcctcccatgctgggcatgcctcccatggtcatactagcgggtccaatgggagcaccagaggcaggaagaccactgggagcaacacccgcaacattaggcagtcctgcacctacaccagtacctgcagcgcccatgtcagcgccgtagtcatagtatctctcgtagggcacaaacggagtgaaggtctgcatctggtccgtgacctcgtcaatgtgcagcttggtctgctgggcaggaggagaacccgtattgttccagatggggctggcggacgaggtggaagttcgtcgagaaaccagcccaaaaccagaagcgtcttcgggtgaagcctttcgagagcccaggttgagctctgcgtctcttgtggcgtctccgatgttggagaaccgggacaaaaatgagcttccactggcagggatgggcgcgtgggcctgagacgggttgaagatttccggggcctgtaggtggggccgctgcatttccacgtcgttgaagctgaagtgtttggaggcaaactggtggtcggggtgtggcagcatggaggagtctctgcggatatcattgccagagcggatgagggaaatgccgccggaaaaggagccgcttcggatggggttgtatgcggggttgatttcttctccttgcgagtttttgcggcccacgccaccgggggccaggtctcgttcttgttggaaggacggggctcgggaccatgttggggtgtctgtgttagttgggggcccgtacgggactatgtggctcttgttatactcaccccatatgcctcgggagggcggagaccggtcccaattgttggactgggcgcggccggtcatgttctgttgttagtggggttgtgactgggttgcacgagcaatctggcggtggatgctgatggggctgcttgaggaacaaagtgactggactcacctggtaggggttatttgtatctgtgtaggtggtgctcgccatgttatggggcccggggttatgggagctgggggattgcgtacttttccgagctgctttgttgggtggaaaatgcaacgtcttggagggcgtgggaatgagtttttttttcaaaagcgggtccgcgaattgcgccgtgtcgagagctgtcggtcagctgaggggcgtcggggggttgcgggtcctcgtgtgttggctgatgaatacagtactatcttcactatcgcggtggagacggaagcttttcgcctttagggtctgcttctgttttactcccacagtggtgtcggtagtgtgctggaagggcgggcttagagtttggatggtgcaattgacgggttagggtggtccgacatagagtacccggtaatgagcggggagtggacgtttgaccggtcgaaaccggcatggattggctccaaatgccccaaaggggtgccctggtcttttttttcccccgcgtattcgccctgccccgcccccacaaccatccagctccacctgcttcatttcactctcctgcgcttactcacatgagcggaagccaaacttagctacgcctctagcccaatactagctggtgcaataccgaagggcgtgtctgacggcttcccctcatcatggcgggtgtggtgcgagcggctcgggttatggaagatgcgagtgtgccggggtctcgacattgtgacaatcacaaaacccatataataaacgcctcgtttacataatcatggtttcatttcgcaattggtgcatgaaacgaccgttttaagaggcggcatgcagtttttatttctttcttaccccccaaaaggcgcggtacgagtgtacgtaatctggtgggcagccttgttagacccatttgcggcttggctcccgcgtcaccggcggccaaagtgtcacgatgactcagcgaatgggtaatcagcagtaatcaatacccaaattgtaatcataaatacactgcgcaccaaagcatactcgcacgacactggtataaatgtggtggtaatcagatgccgcatgtgttcgttttttggtggtgcaggttgctcggctgcagcatacaggcatatgggactctagccacaggagaagcggcgttaatagtcagaaaaatacattgaaagacccttttggccccatttgtccatttccatttagtgctatttacgatactaagtatatctaattaatcacctatatttaggacttgcagatcctgataagcttcgatatataacaatggataagccacagagatggacaagaggggtgattcagaatcggtgaaaaaccaaggacccgactatttatttgatgatgataggtttcgtagatgcggtagaatgtcgtggtttgtctttgtagttttttttccccctgttttgggcttttttgtttgtttgtttttttgtttttgatgttgttttttacatgattttacatcccctattcttcaactattattgtactgtgggtatcttatgcttatttcattgttgctcacatctgtctcaagacacgcaatggaatggattgacactgcccatcattgatgcgcaacggtttcgtgcacgttcgctaaagtcacgccttttttgttcagttgctacgaccgacacttctcactcatgcttactaatcatcccaacgcaccaccactacagtacacaattagtaacacgcacaccatgcacactgagttaatgcagaacgcgacgcgacttggtttcttctccctcttcaactacgcatgaaaacataccgagccaagcgaaaatacctgtcggaatcggaagacgacgtgttttcttcatcaccaacacagtcacccgaaacctcgcctctacagccccccaatgagtcacgactcaacataaaagcagctcaagccgtctcgccatgtcagaaacgagccaaggtcgtcaagaaaccagcaaaaacaaaagcaccggtccagatgaccctgtcgctgggacagacgacttctaccacctgcaagacgtgtggaatgacctaccaggtggcttatggtcctgatatctctgctcacaagagctttcacagcacggccctcaacggacccaaatggaagccctcagtgtcggcagtcgtggtggacaaatctaagacgtacacagtgtacaagtcgcggctgttgagtcatccctgtgtcagccagtttctgaaactcgtcaactcggaactcaatgcgccagagcccattctgtcctctcaggcagctgtctacgtctacgtggtggatcagcgggcagtaggatgcgtgctagtggatagaatcacaaaatgccgtcacgtggacattcagactggtactttgggcctcaaagagtaccctgcagtcatgggagtgtctcgaatgtacgtgtcgcagctgtttcgacgaacgggcatcgtgaccaagttgctggacctggcgaaaagtgacttcatctacggaatggagcttgaaaagaaccaagtggcattcactcagccaagcgagggaggtctaaaggtggccgaaaactgggcggggaccgttcgtgtctacagagagggagagtagacttggagacgtgcgaggaaaggctggaatttgcattcttccagcgagcattggcattactcaatatcatagcattaatacaagttgagtacgtacaagtaattataagtacaaggagtaaatcttagacaatgctcatatagtaaactagatgaagtcagaagcgttagtggcaataaataaaagggtcagatcagattgggcgaagttttaggcgttcggccccgtctgctgaagttggggggtttgttgaaatcaaagtcaatgggcatgagggtaggggagtcaatgccgaccgagaactcctcatgggggatcatgggcgagtcaagaagcagattttggtctcgcgaagacttgaggagatcatctagagacagctttctgaggctaggggggagattaccgcctagatctgtgtcgtcaaagttgaccgggtaggacacctgtgggttgaccagagacatgagaacggagcatcgatgaacaactccatctggccacatgtcactggaggcagcagagtacatccacagatcaagcgtctcctcgatactctgggcgtagagaattccgagaataactgcctccatgtagaatcccagctgctggtagacatgaatcgcctggtgagccagtcccagagacagaagagtggtacagacataatgagtatcgagagcagccgagggaaggcgtcttcggacacgggaaatgtgcaccgagatggccttgtcgaccttggtgggttctctatcaagtagagacagacatagcagagctgtggattgtgtgggtgacagagtgctttccagagagtcaatgttgagagtatagtcgctgtcgttgagccattggccgaggtagaagttggcgatggtgttgtcttcagttcgctggctctggataagttcgtagcaagacgactcccagtcaaacagcacccggagagcctgggattcccaagacaagcttggagatagagccttttcggccattgggtccggtacggacatgacaatgtggaaaagcgagatacgcgaggtgtcgataggcagcatttcgtttctagtaggcgtggtctgtcctgagaatcgggtctttggtcgacagttgaggagaggtttcactggcacatcatattcggagccaggaagagtatctgcggaggtgttgctgctgcgggtgtttgagaatgctgaggagggtccatcagattcatcgtcccaagagtcggactgggctccagctgaaggaggagggggagggggagcttctgtaggaatgggaatcaagggcgttcgtctgggaagaggtcggggaggtgaaggtagcagttcaggtgtaggaagagcgagttccttgacttgctcgacgctcccttcgctgctatcgcttcctctctttctgttttccatctttttatctcctcctacaaggtcaaggaactcgatacccccggtggttgccatccaggccttgcctcggttgcttttgatacagcaagacacaattttcccggtcgaaatgattttggttgacacgttcgatgtcttaacgttgtggacgcacactcgggagtcattgagggcgtggaacagcgatccgccctttgtccaccatatgggagacgcagtgtgagctccatcaggcagtccaaagcaccgaatctttctcaccatggacttgagactcacagaccacacctggatcttgttgtttgagtctatggcggcaagtgactggttagaggggtctcttgaggagtagtgccatgccgttgtaagagcgtagacgggagttgtggcaggttcggactcgctgtccttggagaagtcggtaccggagcctcgtgaactgagcttgaatgtatggtaaacttccagttggtgtgtaattctgagcaccgagatggagccgcttttgtgagcaattgcaaagatgttgtcgccgcagggagctgccgaaaccgaggtcactgctcctccaatcatggcaccaaagggatccatctgatgagtgagagtgttgactctatagagggttccgttagttgtgctgagcactagggctgttccatcatggttccagcacacgctggtgaagatatccgatttcggcagcttccattcggctacctgacaaaagtggtccttctttttggtcaggtcgaatactgccagatgaagcacgttggctgtgtcgagagtcgccagctgagtcttgtgggcagtcataaaccgaatactggtctggtcggacacctggtagcccgcattgggcactcgggtcaggttggaggggtcgtgggtatagacagtcgcagtgtcgggttctactacagccagggcaggtccacagatctccaccagaactttgggggctgctggaggcagacagttgtaggacattttgtcgaaaggagaaaaaaccgtgggagtctggggacagatgagagatgagagatgagagatgagacgagatgtttccgactctctagagtggtggattcagccattattagccgatcagctagcatcactccaaagtgcactgtttcccagttaggcaggtgggactccatggttagagtttatagttgcaagatcgtaactttcttctttgtctatggctgcacaagttgcattttgcagactacatgctactttcactttgcgttttggaccacttgtccataatcacagtctttttcggtgccctgtcgattctcaccttttaggtggaacataggtgaggctctcaacggtggcctaagatgacatctggccataaaaacaaacattaggcctgaaaaaagccaacaaagcggacaatgtagaataacaaacatgcggctttgtaggtctccgccattctttcatcgtcacgtccaacacgtccaacacgtccatcatctgatcttccccaggggtgtcgatcgatgaataacaatagggaatagtgtgcaagaaaagagaatgtgagggcagatgattcaacaggcctgcattcgtccaactgactccaatattgtttgttatcattcctgaagcctggtgggttttagcacgccaatatcgccatgttctctgcgttggtccacggtgccggagccgtattttagactcggcctacctgtagcttgtacacacataatggctcgcctgccattgtccataggttctgcaagattgggtgtgagcatggccgctggagagaaaaggtgccaggcgaagacctagaagagcacctatagcttagtggagtcgtcggtaatcagcctggagccgaagccgtctgtagacatttattttcagctactggaaccaggtctgtttgggttgaacgcgtcgatatgccaaactcaatagaggttagctttgcatggaatgtatctctagattcaactacaagcacgctactagccctttcacaccaccaacaacattagtcgggacactctccctaagctgtgtggaagcaaaggccacagagaggcgaatggggacagacagctactaggatattagtttttggtggagagacttgcttgatggatgtacgtacctcggttgatttatcaccctggtggtagtacgagtaccggtgtaagtgcgagtacttacaagtgtatgtacagtatagctatgcgtctctgcttccggaaccagtcctcacctcacattctcctccagcgtcgcattttggatctaatgctggcgtgcaaaagactacaagtaggcactcccgtgtttacgatcgcgatctagtcttattcctcgatgggaccagacaaaagggtcaccttctaaagcggaagtagtgattacccaatgccggattcgaacgtttggtatttagccaatccacccggctacccccattcggtctctgtctacaccctccagcacgcacatcaactctcttggccgcgcctcacgttatctatagaagcacatagcttgccgtttctccatcttttcttccgttgggccccgaagtatgtccaagtacagttcataaaaacatgaattcctctgtactcgtgctaattagtactgacgcagtaggccaaaaccggacaacaatctctctacaaacgagcccagcccagaaaagcgcagagtccacaataatgtcgacatcacgccataaacctgttgggctctgcacacaggtgagagccgttgactaaaggacttactgcatccgtagactacagtaggtcggcttcgtatgtacccgctcattatcactactgcacttttttacgcagggtcggtttcgtgccatggacataaagtacgacaagtgtactcatcctgggcataacaccaactatgctggccgttgtctgtcgaatcccaatcagacaaggatcgtcgtccaaacgagcttgtttctttgtctccagcttctgtgggatgtctggaaccatattgggtttcgcttgtatcttttgagttaagcgtcgtttccatagaaacacaacacacatgaagacaatggtatggattgatagcagtatggcgtgtggtgtattagtcacgttgctgtgacggagaaatactcgttgttagttgttagtcgtctttgaatcgccccgatagtgatattctggctcttcaatatcgcttgctgtgttgctactcacacatgagtgctcatacatgtgcagtcttcggatcatactcgtaccaaggacttcatacgagaggtctcagatcacgttaactacttttaatgcactccagcggggcagtgtcacgtatggcacgcgaatcaagatacaattacgacgtgacgagaatcttagaacccctgatcaacatggtcctatgacggagctgccagacgtcagaccgcactctatatcaccagggatttgcttttttcattgtatgcaaaacagacggcgtatctctgtctcgtacacttagactcgctgacatacatagacttccactagcgaaggtggttatgcgtgtgtgttgtaaacattggtaaatgagcgcggacaaatgacggtggagacagcccagagatgtagtttgacgttaacaagagttgaattggggagagttttgcctcccgcgctacttggtacttgcttcttatgcaccaacaaagtggtttgttcataactgctctcgtttaggaagtatttgcttttcaaacattgcttttacgaccaccaagcttcctcgagacttacttttgggcggggaaagaaggagtacaagaaaagtcggtttattttattttgcaaaccctccctcaggttaactgttcattaaagcctcaaattccgtttctcaaacgttgcccatacgtccattagtcttggagaggtgtgagtaaaacttgtatacgtgataataccttcctgggtgtgtacatgatccatcaaagacccagtagctcgttaaatgtctcacatatgtctcataatcgctccctgctcagtgtgaaacttgctgctgtctcatctcaacgaaaacgcgacgacagcttgatgtttctgagacactagaacgtcgcaacgcggagctgatatcgagcggtgctgtttgaaaacacgcttcagaggcaaaataaactagggcagacacgtcttgggctgactaatctttgctgactaaacatgcgctgataaagttgaaggtgcatgaggaagatgatctgacatctacgataccaacccagctacagccatgacctggttcaccaccatggggatgttcatcatcgatgaaatccactttggaactcactcggtatacgacattgttggaggagcgggaacttacggggttcttggagcgcgtttctttgccaaacaagacaaggccaaggacattggatggattgtggacgctggaaacgactttccgcagtcggtagaggaacagattacaagctgggacacaggtttagtcatgcgaagagatccgagtagaaaaaccaccaggggatggaactcttatggagataacgaccttcgaagcttcaagtatctgacaccaaagaaacggatagaggtgtcggatctccaggaatgtggtctggactcttctcgtagcatccacgtcatctgctctccggatcgatgcatgaaaatctgctctgatttggccaatggacctcgacaagaccagcaggtgttcctatgggaacctgtgcctgactgttgttgtccggaaacgtttccgaccatgctacaggctctcaattccgtccaggtactttctccaaactgccacgaggctgctttgtttgtaggtcttcctgaacctacgacagtgtccgaaatcgagtctctagtctacgactattgggctcctcatcttgacaagctgaaaacggtgtttgtgctgcgatgtggcaagctcggagtgttggtctacagtgacaagaagctcaaatggtaccctgcgtaccaccagagctcggagaaggtgattgatcccactggagggggaaatacatttgtgggaggcttcctgtacggctatcttgagagcgacggagacctggacactgctgcgtcgtatggaaacgtcgcagctggattggcagtcgagcaggttggagttcctcttctgacctaccaacgcggacaagagctgtggaatgacactaccatcgagcagagattggacgtgtacgcttctttgttgaaggccagcaactagcgtggatggcatggaacatgaatggttcaggtttagtatccaatatactaaagagaagcatcgaaatattattctcagccgtctagagacagagtcaagtgacttcaagtgtgaaattaaacgtgtgaaggcttcgaccctgatattgctctgggaaattaatcacatggctcgggggcagaggcttaattaacccgcttaatattacatgattgtggatatgagacatggatcattctaccggtactttacagccgttcaggggtggttcttgtatatttaacaggtcttcaggtggtccaggtgtgtcatgtgtaatcgtacttacactacacatcggtatgtgtacggcagtttttacagagcggtcctcggaacctgttcgcacgtctcatatctcattgtccccttgccaacgcctattaactccatatctaaatcagaacatgtaatcattacaaaatcagccactgagacagctctagcacaactgctgctcttctagaatcgaaatcatccgccagtaagtcaccaatcaacctaaacagcctactgtagcctctgctcgtagacagtaaacgactctcagtcgcactcttaatgttatataaatatgcactagacttccaactctccggcgggctcctcgtcgtcgtcagaaaacgagccaatgctgctgagatcgtcatcgtcagaaatgtccttctctgccgacacagagtcgttgctggcgtacttggtcacgtagtccttgaccttctcctcgtactgcttgggctctcgcatcagcatacccgaggcctctccgttgagaggatcgctgggattcggatatcgcagcagctgaggcaggaagacctcaaagatgttgaccatgtcaaacatgggggaccacgtctggttgatgacatcgaggcacacgctcccgctgagctcgtcgatatttgggtggaagatcttgttgacaaagccgatggagggcgacttgtatgggtactcgtttggcagttccacgtggatcttccatattcctccctggaacggtgtttcttccggtccttcaaaccgcacgtaaaactcctgcatgctatcattgaccagcgtcacttcgtagtcgctcattagcctgtgttagtggtggaggcggggtgtcgctggaaagatactcacaacttcatgacgtcagtctcgattcttcttcttgttggggaactgtgttagtttgtgtatgagagtggtggtgaggttgtaatgagggtggagatatgcgaaccaatggggtcagtatggcagcagcccaacaccagctctctagtcactgagcacatgagcataagcaatttcagggagatattcggggataacctgcccgaaaaagatggggcttcaaatccaagcaacagacatgtcactgatagctccggatagcgtcgctgagtccataagttccgtcaacccatcagtagaggcacattcaggcagaccagacaggtttaggcagaggtgtggggtccaagcggagtgtgagttacagagcagaatcacattccaaagtaggccatcgatgtggtatcgtatctggctcagacgacgccctacggcgctttgggagaccctttctctcgaccttttcctcgatcaagtgctgttgtcaccttcccagtcaccctatccagtctggaccccgcattttattgggggtggccacatccaagcaataaccggaggtagtcggaccagtccagtttgcgatgcagactgggatgtgttttgagactcccaagccttcacctacatgtctttttcatatcactccgtccgtcttcgcccctggtccctctcccgtctgtctgcgtctgctgtagtaccactcccctagtggtgctatctaactgagtgaggggggacccgccacctggcgtcgtggaggtccgaggctgtgttttttgtgcttctttggggccctgagatgctcttcccccgtctccgtctcctcctctccgtcccttttctactcacctcatgattgtcgatatatgtgtgtggttatgtgggataatggggttatcagttgcgcaacatgcaccttgtcagctgtggcgctccgggcgtagtgtgaccaagttacccttacacaccgcactccagctgcaccgcactgcacactgctcccatagacacacggtttgtttcctcccacccaccagtcaaccacagtgcacacaaataaaaattaagcttcgcctctttttggcccctggccgggtcactcccacaactgcccccctccataatacttgcccagtagagttggcagcccatagagtagctactccggtagtttgaggcaactttagaggtgataggaaagagagagtgagaggcgtgccaaaaacatgtgggtcacccaaaaggagtgtggtgagaaaaagtacagagccacatccgggtaaatgtctcacagtcatcagtgctgaccgtcaccggagttgctagggcaacgcccgaccaccaagtgtgaccccatgtgcgatgcgctcactcgcagatgcgtaaccacacctcggacaacctaaaaaaatatctcacggataccagtctggaaaaacacttgagacggaaacatgaccgaccgtctgggacccgaagagcgccaaatggccgctgcgcagcgtgcgtacactgcagcgtcccgaggcgagggcattgagacccccgccgtggcctacgttcctcgaaccatgagcttcgagtggacgtggaagtacttcattggattgtttctgtggatggtgctgtacgacgcaattggcgtggggtttttcaccagaggctttctgctgagccgcagtgtgctcaccgacgtcagcccgagcgactggcagctcacagagctccacgaacctccccatatcgacaatggatgctggacggagcccaagttcgacaaggccatcatgctggtgattgatgcgttgcgattcgacttttcgacgccccagcccggctccaacaagccctaccacaacgccctgaccgtcatgagcgaactgaaccagaaccagcccaacaaggcgttcttgtccaagtttgtggctgatccgcctaccacaaccctccagcgactcaagggacttaccacaggctctttgcccacattcatcgacgctggaagcaactttgcgggctccgaaatcgacgaagacaactgggtctaccaaatgtgggctcttaaccagaccgtctaccagtgtggagacgatacttgggacgcgcttttcggcaaatactttgctgctgccaacccctacgactctctcaatgtctgggatctgtacacggtcgataatggagtcaaagaacaccttctgcccgcctacaagtccggaaactacagaatgagcattggacatacccttggcgtggaccatgctggacacagatacggacccgactctcccaagatgacagagaagctccaggaaatggacgagtacattcgagagatcattgactccctagacgacgatactcttctcattgtgtttggtgaccatggaatggattccaagggagatcatggaggagaaagtgatctggaggtggatgccactctgtttatgtactccaagaaggactgggttgctccgaacgatcagattagtgagggcggatacccttccattcctcagattgatctggttccaaccctgtctcttcttatgggtctccctatccccttcaataatctggggtctcctattgctgaggccttccttggccccaacaaggaccccaaggctcttgccaacgtcctccagctcacttctgctcagattgaaaactacagacaaaagtacggctttgatgatcttggaggactgtataaaaagactgtgaaggtcgactcttctaaggctggcatgtgggagtccattgtgtccaatcactacaactttcagcgaaccaacctcgaccagtgtcggtctctttgggcccagtttgactttgcatccatttttgccggttttgcaatcattggatcttctctgatcctcatgattctatacagccgactgcccattttggacgtggaaggatcactcgagaagctgtgcaactactctggtcttagtgcgttcatgactgctcctgccttttacgcacttgccagctacggtgcattcggagagtcttggccctttgatgctctatggactagcgggcttggattctgtgtgggaacgcttctcggttactccatctactacattcgacatttcagcaagaagctccaacgagctgagattggaactattgccgtgattctcatcactctcatccatgtagctctcttcacctccaactccttcaccatttgggaagacaatattctgtctttccttctaagcaccattggtttcggcctactcatcaacgccgcccagctgccctcttccaatgccaacagagcaaaggccatttcacactccatcatgttcctcattctcactcgaacgtcggctgtctccagactgtgtcgagaagagcatggagacaagtgctctaccactttctactcctcggatgcctcctccgtatcggctccttacactgtggctttgcttattctgggcgcattcctgttgcctctactcgtcaaaggcttccttattgagagtggctctgaccatgggtcggcaaagttccacatctggggtctgtttggcgtcatgatgtctgttgccgtctactggttcctagacctgtttgtcactgagcagctcaaatggtcggatcctctgtttggcgacattgagctgctgtccaacatgaagctgaccattgcccgaatcgttctgggagtcactctgctggctgccaacgtttcgtggatgtttggtctgtgtgtggaggtcaagtacaccaagaaggacggagtcaaccaggcgcagattctcggctacagcaacgtctacggtgcgcagtacctcctgctggtgctcaacttctttggagccattctacttgtctccaagcctcttggaggagtcatgatgatcatccaaatgtaccatatcatgaccaccattgatttgctgcacatcctcgagacccccgctagcatcggccccgtcattctggctgtgcttggaaacgcctacttcttctccactggacaccaagccaccattccttctgtccagtgggatatcgggtttgtggccacaaacaccatctctttccctttgacgcatctagcccttgttctcaactctctgggcccccagattctgtctactgtttccactcctctattggttctgtggaagattcctcccgtgcggaaatcgtcgctgctttttgcttcttgtggacaatccatgctggtgtctgtcgcctaccagactgctgtcactctgtccgcagcggtgtttgctactcacttccgacgacatctcatggtgtggaagatcttcgcaccccgatacatgctgggaggcctgacactcatcgtggtggacgtggtcgcagtgctggtggtgggctttggagtgggaaacatcatcaaccacgtgaaaaagacctttggcactgatgccaaaaagaccgtcacagcaaacacttccctcaagagcgatctgggagaacagtgggatgctcttcagtaatttataaactacaatacactagaccacataagatattcaatacattgcattcttaacacgaacacgcggtacaagtaggagtaatacaagtacttgtacttgtagtatgagtacagtcattaaatatattcctctacatcactgaaactagggaaggtccaaccgttgcacttcttttcacaatacgttaactatgttagattaccagaacatggccagagtaacaggctcgtggacgggcatctccttttccttgtttttgttaactcggtcctggagagcaaggaacttggatcgcacctcaggcttgccccaaatggcaaggcagaaggtgtatccaacggttttggcggagacaggggcgtagacggattcaaccgagtcgacaatgtcgtcgagcaggtcgtcctcgtcctcgctgtccgagtagccatcggtgagaccacggggaagaccccagtctccgaggttgtaggcatccttgacgtcgaagtccagctcctctgcaccgaaacaagtggccgaatcggacatgcccgagtcggaaccggagtcggagaacgcagaaacggcaatagcgctgagctgagacgtgcagctgactgagttcgggatagtgagctgggacgccatggaggactgggaggttgatttggagatgcggttggagcatcgggggacctctgcgagctgctcgagcacgtcggtgtcttcgatcgacaggtcgaccgagccaaacgactcgtgggaggtcacgggggtcaggttgtctgaagggtcgtgccagaacatgaacccgtcggagcaagccggggagggagagggggaggcaggcctagtggatgctgccggtttggaagcagcagcagccacggccgccgccttcttggggacacaagacgacactgggctggtcttgggcaaggtcattgaagacttcttgcttgcgactggggccttgtcggccttgtccctgtcccctctcaacagactcctcagcttatcaccaaacttacgccgccgtccggcaaccttgtcggcgctgacgatggtcctggaaaccagggtctcgtcggacagcaccgactggggtcgtccgggacgggtggacacaaagtacttgtggtcctcgtggcgggctgggctctggcgaccggtaaatcgtagaaaggccattgctgcagagcgtgtctttacaatggccgccggtctagagtgctgctaaaggaggttgcgaggtggtggagttccgggtggtggtgggctgtagccttgcagagaagaacactcgggttgggaccaacggtacttttaaggcgctgtgtcaaagttcgcactgtgtgaactttaattgtcctgagacaaactactttaggtaaacacgtattggcgagaacaagttctagagagacacacgactgggagatatagaacgcggaggagtgggagtttggggagcacgagaacggcgaatagagcccttcgaacgcaccttcaacttggaccctctctctccctcacacacacactcactcttctgtcattcgcgcccctttaattatacgactgtctatcaacccacccaccccagcctgtcactcacatggcccgaaatattatcgttcctttcactcatttgcaaactctcagctgattggacatgcctgtggggaagcaaggttggaatgccaccaccagtagcggctaccagtgctcgaacccgcgctacaagttgtcgaccaagtggtaacagcttctctatcatacacaccagcattgtcgttattgtctgcattgctgacttgcggctatactgctcgtgctgtatgtgtgtgtgtgttttttttttttttttttgggactctgtcccttgcaggctctctgctatgcaatgtgctgtatagtggtggtcaaactgagctgaccggctggggctagtaataccggcaattaaacgtgcaactatccaacaaataaacaaaaccggcgtggaaatctactgagaacgccgagcttggccccactgccaaaaaaatcgacgctttcgccaaaccaaccgccttttaacacaccccattcccccccctcccctccacctacaagtagtcccctgtcaccccatactgataaacccctaaccttagactgtaccccgcggtctgttaaaatgtcagccgggtaaccccgacggtaaagcttaattcatgcgcgtgatagcgcacctcggggccgatagtggagtgaagtgttctgaagtccattaggccgctgagtccgtcggctgacatgttcgaaaagcggcccatattttctgattattaatgtctccgcgggatcggcaaccccgtcttaatgagccatttatagcgactgagacagcacgtattcgcgtctctttttatgtgagtctagaacttatccgaaacagaagaaagaacgcaacaattgaacacgagcacaacgaagtgaaataccaagagggacgctacaactgtttatgatcgtggtggacgattaatgaacatttattttcctgcccaagtctcgtcaatgtcatttcacgattccaatgccttccatcgtcggcatatgtgctcgattctacacatgtattattacagtacaagttgcaagtaagaatgtacttgtacttgtacttgtacttgtacaatactgccaaaatgtcactcttgaccggccaggattcgtacttggacagtacttcaacgtccacccatctctgtttattttttttagtcgtattagtcacacactactacaatcacatataacaagtcattcattcatagagtatctcaggaatactaaacataacttaggcggtaagaccaatgacaccgcaggcgggtcgagggccagcgtttccggtcttgagagagtcggcatggccaccctttccaagatcgtcctcaccaccgtggataacgacggttcggccaacaatggagttgtcaccagtcagcttgagaagagagtccttgagaacacccttggcaacaccctcagagtcagtcttgacgtttccgaggtcaccaacgtgtcgctcagagtcggtgggaccaccgtggttcttcttgaaggggttgaagtgggggccggcagaagtgcagccgttggtgttgtcaccaaactcgtggacgtggaatcctcgctcagcgttgggatcgttgcccttgatgtcgtaggtgacagtgacggggccggactcagagtcctgctcgaaagtgacagtaccggagaccttggaatctcctcgaagaacagcgactgggttagaatgtgcagtgtgggcaagtggcgaacaacgacatggactattccgtgaggtagggctctcaattccctcctaaaatgcaattgtgcttgtggggtctgatctcaacaaacaatgagcaacttctgagtcacctgccacctcacacggcgcaacgttccgccaccttccagacggttgtcgaagtcaacgtagcggccaacctgtgggtgtggaccggtcgagcggccttcaattgacccgctggccgctcaatgtgcccgattccgggccttgctctcgtactcaccagccttgaccatttttgatgtgtgtgtttagtgtgtggaggagagcaaagccaggttccgcactttatatattttgctggagcctgagccgaagtggcttattaattgagagccagagtcaatttttttccatttgcggtatactgtcgcctgggttgggtattgtgtaatatctcgtgcggaagcacatggtgtccgtttatggtggggaacattccttatcgggaaggcagattataccaaaaacggattctggaatatctcccaattaggatgcaatatcggatatcacgttgtgggtggtcgtggagaggtatcagagcaagtgtgcggtcaatgagggacgaatacccgcattctggcgggcctgggtactgctcaagtaagtggaaagcaaaaacaaggaggaaagtagcgcgggctaccagcaccttttataccaccataccttggaggtcaatttgctcatctggagagcatataccccggagcttattacatggtcagttgttgccacactaataggcaggcccaaacaagatgtgaaacggacggaaatggacagatggagtcagcattttgcggagagcaaacgttggggagagttcttttgttcttgatcacgtcatgcttctgactaaaccattatgactaagccattgtgactaaaccattatgactaaaccattatgactaagccattatgactaagccattctgacgtgttgtacgatactatactggaagtacatactgtgcgataccaacaagtcccaagtactgatcgatacagacaatcgtaccactgtttgtgcaatgacagtttgtatatgaagacaaatttacactgccagttcttgggctttgtacaatggcacgatattgtttcctacttgcacccattgtctgctatacactgttgtctataatacatacaagcatcagcacaatgcaccatgtgggtacaatgctgaaacaagggtctaaaacggaggtcagaaacaatggacaaagaagtgagtctggctgagcaggcagtttttctcgagccctggcaagctcttttgacaagccggttgcgtttcaatcaatcacgccgagctagcccccgattctccgggcccagcaacacctcaacagggctaagcagcctgcagattagctactcgtctactgtaaatcggctaatcaaagctaatctggaaaagttgatgggtgaggatgcattccgacatgaataggagaggtggatcagttccgtgggccagggtggttagcggcttgtctggccataggtggtcgagtcaagagtgctacagcacacggcccaaatcaaacccaatcgcacctctcactcaacggtatactgtatacactgctgatgataggcctcttctctcacctctgacgaagtcgcagtcaagtaatttaaacaagagtgggccaactaacaatggagcgtttctctaaagtagactctattgtaagtataacaagaaaaaaaaaaaaaaaaaaaaaaagtaccgtgcaatactgcagcgcaattgagttcaaactcgacccacaaaaactggccccaacccaggaacagtgagactcgtgggttattagctgacagcactagtgtctggagcaggaaaaaaaattacggaaatccgcgctttccgcccgtgacaagcccccaaacccatactgccttgtcatcttctccagctctcgcacttcacataaagtaacctttactcccaactccgcagccccacagatttgcctttagatttttgtattgtgtggtgtttgtgagcacgtgacgcgtgccactcatacgtacagacagtcggtgccatcttcaccttcacaattcactttctgcaacaaaacaaacgccatttaggcagtgagtacccgcagcggaccacgtctcacccccagcgcccttctaacacagtgcatcctcctccattacctccaaagccgcctgctgaggtcatcaacagacggacccaggtgacggatgagttcagaaccaaactacctgagcgagtatcgtcgctcgtggacaagcgaccgtcctatcacccgcaaggaccacgccagctcaactcggacgcgccacaacagaccaatcggtacctgggcgtctactcttcgccgcaagcgccaaactggagagatgaagagagaagcgtggaaagaagcaacacagattcgtctgatagaacgagcggcagcgccaccgaccgtgccagctactcatcttactccaccgaccgaaccagtatccacggcggcgtctctggctactacaacgaccccaacaatggcaacaacattggcaccgactacgataagttctgggcccaacagtactcggacgttagccggaccagcagcatgcagtcgtggcggcccgacagcgaacgaccgccacctctgcccctcaaaaaacccgcattgaacacctctcacagatctaatcccgcgtctccaggacgagctcacttctcacaacaaaacacaaacacgccccctccactgccaccacagattcccatctacgacacatacatggagcagcaagcatatgaggactacctggaaaatgggttctacgaccagcaatcactatatcgtacccccgagccccagcaccctgcgcgtcactttactccgtccccaaacgcccaggacagataccagatccctccgcatttgagtccaggccacagctcgtaccaaccgccagctgacctgcctgcattggacaccaacgactggagccatgtggcgtctgcatacgaaacagacaacatgtatccggaccatgcatacgagtctccggtgcgcatgcctgtggcagatgcctacatgtcgcctgggagtcccagtccgttgaaaacagagacatactcgcctgctccgtctcagcaatcacctctgcatcaccactcttcgcagtcgtctttgaactacatgacgtctcagtcgtctcccttgactccccagcagtgttcggaacgagatttggctctaagaatggagcgactggatatgcgtcctgccatggaacgattggagcctcgtcctatggtcgatcgaattgatatgcgcccctccatggacattcgaccagtcgatatgcgacccacactggagaaacgcatgagtttgcccaacggaatgcccaagtaccagccaatgtcaccttctgtgtccccgtcgcggttcaactctatgcccaacaagcgacctgtacctgtatctgcaggaaacactcccgtcaagcagctcgacattcccgagtacgatattctgtcggacagtatgcggtcggataccgcctgggtggagctggatctcccgtccattcctacacgaccacaggtggatctctcaaacgtgacgtacgcatgtcctgagatgtggtcgctgtctggcgttcgaaactggatccgtcctttcttcacaggcgacaaggaggtgcctgagaaggatttgcatacggccgtttcgaatctctttgccgccaacaagaccatgtctcctgtttatgctgaacagtacgccaaacacgtaatcggagcccttggacgaggcgacgtgcttcgacatgatgaggagagaggctcttatatgttcagcgacgaaggtgtcgtttcaggagttatcccagccctcaccctgtgctatagcaagtcgtcgcatgactctggatacacttgttattccacaaagtgcccatatgagtccgacactcggaaacgagaggacaagaagcgcaccgaatctacatcctctgaccagatggactgggcgcagtactgggagctcaccgatgaccagctggctcgtattgacccccgagaaatcaagcggcagtacgccatgcacgaactcatcgtgggagaggagcacttcattcgtgacctggagattctgcacaacgtctacggcgaatctctcaagtcacacatgcccgacaagcagtttcgggacatgtttgctgttcaggatattatccagtgttccaaggagctgctccagggccgtctcaaggccagacacattatttttgtgactggtattgccgacatcatcatcgagtggatcaaggttgctcgtccacactttcttgcctatgcgaaccggtacttgcatgctgaccggcgtattcgaaaggagcgcgaagacaatgttttgttttctcagtggctgggcgacatgtcgaaggaccctcggacgctcggaaagccctactcgatctactttcatcgagttatcccccgtctggctcgatattcgcttcttttgggcaccatttcgaagcatactaccaacgagatggaattggagcttctatcacgtgctgtcgccgagtgtgatgacgtcactcgacaatgtaacatggtgattggcaacgtcgaaaagcaggtggagctgttggatctcaagagccagtttgtgtttaagcccgactgtggtgctgatctgaagcttgagagcactcagcgaaagattatgcgacgaggtgacgtacagcgaaagtccgactacggctttgagtggattgacgctcatctggtgctgttggacaactttttggtgctgtgcaagcatcagacaggtcagcatggtcccaaattgtatgtgacgaaaaaacccattcctctggagctattgtgcgttgagcagattgacgaggccgagcagcagaccaagggccgaattcacaacatcacgtcgcatgttcgagaagtcagagacaagcgaatgagtttcattggcggagatcatcacagcagcagctcctccaaccccggagcagtcaccgtgctcaacgaggactccgatcagaccacgtatcctttccgaattcgccatctcggccagaacatcacctacaccctgttctgtccgtcttctcttgatcgagacagatggcacactgccatggtcgaggccaagcgtcagtactccagcaaggtgtatgccaagaacgccgagcccttccggctgacagttctgtcatatctcgactttggatacgagattcctgttcgcctggcagtccctaacaatgcctctactctccagagagccattgaaaaggccggtatggccggcaagccgcatctgaagacccaaccgtcttcgaccagcatgactactcgaagcaaggtcaactgtgctacgtcgttcatgtttgattcgcgtgaattcgtttttgtcggcacagattacggtgtttttgtgtccgagttatctcccgagacccgtcacaagggcggaaacaacaagtacaagcggtgtgtcgacttgcacaaggtgactcagattggcgtgattgagacactcaacttggttattatcctgtgccaccgtggactaatctactaccatctggaccaactgctcaaccgaagcatgaccaaggatgcggccacccccatgggctacaagttgtcttcctctgcgtcctttttcaccattggcaatatgaagaaccgaaccctggtattctacaagtctcgcgagggtctcaactcggtgttcaaggtattggagcccattcggcaaaagggctctcagaagaagcgatctcgaatgtcgctgtctcggttctcgtcgcatattgggtccaccgagtacttcagggacgctgagcggttctacgtgccgtccgagtgctggggcatctccgtgttcaaaaactacttttcggtgcactgtaccaagggattcgaggccatgagtctggatttcaaggtgcctcgaacactacccatcatctcttctggctccactgacctcagaaagcgactagaaggactcaggcccctggccatgttccagatctcggactccaagttcatgctctgctatgacgagctgctggtgtacacggatcactttggcaacctggcctccaagcccattcccatcatgataaaggccaaggccgtggcacttcaacatccctacctggtgattgtggacgacgagatggccgagattcggcacattgatggtactctcaagcaggtgattcctggccaggatatgcggcttctcgacgaccacgaaggccagatcaagctgtgcatggcgaaccccaatatttacggccgccaactcattgtcgagctcaacaccaacgagcttattgttgacgacgacgattcgtctctcacgggattgtaagagagagtcggacagtccaagtccgtgtatacatagtttatttattgtcatgttaatgtgagcattatatcgaaatttactttctattatttgaagatgaaactccatagcacgagaacatctagtgcctttcttttggtttcactccttcagtctcccatatcgtcaaacattcatactaatgcttatggtataaacaaacatacagtgttgtactgataccactcagtttctactctcggaagtaagcaccatacgaaaactcactgagcagatgtgaactctctatctatcataaaagtcatggaattcattaaatgcggttgaagagcaccacagtggactggataagtcacgtcatcttgctactcagctcgccacgctcgtaggtttagcctcgttggcaagttccccctttaacctagtcaacaatgtcccctcgttgtttggccagttcaactcgtcataaaccggcgctgtcatgtctagacactttgccatctcacccttctggttggcatcagcccattcacgagcagacaacaactgccacagagccgcctttctgcctttgggagattgtgaaaaggcgtacgatacccgcaacatgatgagagcataacccaaacggcccaccagccgctcatccaacagtttctggaaccactgagttgccccctgtgaagcagcgtcaggaccaagcagacactgcaggtccgaagttaccaccagcattcgaagcgcatactgtggtaattgcagccgcgaaatatatgtatagcatgctgagtccagcaatgggttcagcacctcaacccgttgtttctccgtcagacgagtagtgtacatgagaagggccactgctgcctgttcctgacatgctgcaaggtacttccacgccttgtccgacaggaaatcccgttttaccagctcgtaagtagcatatgcgtatctgtagtctctcagcatgaacgcataatctgccaaacgtcgaatcgtctgttctggagacccctgggggtagattcccgatgcttggatggatgatcctgcctcctgtttctcgcttcctccgaacttgagccactttttgcccgcggaaaacattcgacctgttagtcctcgttttccggctgccaccgtatcccacgtcatgatacaccgttccatgtgcggaataagatgctgtacggtaaactctctcaaaagcgaccgaatactctccttgtcaggctgagacaaggtccgagaaccgaatcccactccagtcttaagattgaccagctcatcgcccacggtcagaaactgcggcgtggggatcgtctccggaacaccctcctggcccagtttgatcataccagccagtccaaaccgcttcttggcccgctccagcaacgcaatggttcgttgcgtcgagttctcggcgtcctccacacgtgcatcgtgcaccagcacataaaagttgagacagtccttatcgcgtttctggccctgggccaaagcctgcaacgtgtccagaggatgcgcgtttctgctggagacacaaaagagatgcgcagccggttgagaaaaggtctcaaatgccgtgtccggtggagcagccaccagtttggcgaaaaaccgggcaaatgcagaatcgtcagagttgtagtgaccaatgtactctctcagaagcgcctccatggcgtccgggttgaagagcatgccgccagagtctctctcggtgggtcgcttggcacccagtcgaatggcaaagtcgtcgtacgtgttggtcatgccctgggagtctcgaactgtggctcttcctaccgagtctccatggggggccagaagagtgatgagatcttcgtatccgagatcgttggcgagtttgtcgcagtcttccgtggcgaacacggagcagaacggcgagtacgcccttgccactatcgacttcatcatagttgggttgggagtgttatgttgtgagtttgatatggtgatgtgtgttagtagtacttgtagtagtagacagacgaccgagtgctgggagagccaaagggaagacagaaaacgacaacagacaaacgattgaagcaagagtgaaaacatggagttacactctccaccctcccgtgattagtcagcattagtcatcacaacgaacagacccaacagggtgcttgtagctgggtgggatacgtggccagatatgtcaactaaatatccaagtaggggccaactaaacgagagtttgagaccaagtagaaattcaaccgacactgactccgggccaactactgtacttagagaatagtttagttgacttctctatgatataagatggaaacatccaaagtcgagcccagaatcaagcccagaaagcccacgtctcagtggatagtccgcggagaaacggagaccgaaagagacaccaaacacgccacaagtggccaatttcccccccaaagtcggtactgtagacagaaagagagactaacgacgggctaaacattgaacggcccaacatgtacatacagtagccatgccgaaacggcggcataaagtagcttgttttgcgctgccggtttcatagtctctgtatttgccgctcttggatgaaatgaactttgcccataagtcaggcacccagcaacaccatcaataaacactctgttttgcctataattagtgtctatgaaaagtggccaaccagagacgccaagactcggttaataatagctcgtgacttttgacaacttaatcgcgtgcagtgaactaatgggatgcagagagctatgagcgccatctataatgtcggcttccagggggggaaagggaacattactcagcattttgaggccgtgcgttgccccggtgatggtccgtgtatacgtattgtgtttgcaaaacgttgctgtttagacatgggccagttgggttaaggtccagtgtcgatctttttcactctttggctgataacaatgtctgggaaaactacaaagtagggttcatcttacgctttaggaggggcgaataataggagccaggggtgcagtagccggtaagaacggttggtcctttggggatccacggctgcgcattagtttagaatgttagatagaaaaaaaaacaaccagagtagggctctttttcacggagcatcttcaccgagccagagtatgagcacttggcaacaaacttgccacagtgtgtctcgagtttcttcttgtttggaaaaggaaaaccgtgtctgatttaaattaaccttgaaagatggacacggctaatcaggaacacttgcgacggtcctttggcgcagcatctctttctccaccagcagcttcgcccgccctgcataccaaacccatgtttcgccggcgcttttccaccactcttcttctgctgggggcctgtgtgtgtctgctgtttctggcagcgtcacagtcccgtctggacctggatgtgccctcttaccatggctaccgaaagtccaaagaggtgacggacgaaaagttgcatgttcacaaagagcgtcctcaggaggagcatcacgaacatgtggagcataaggaggagtccaaggaggagataaaggaggagtccaaggaggagtccaaggagaagtccaaggaggagtccaaggaggagtccaaggaggagtccaaggaggagtccaaggaggagtccaaggaggagtccaaggaggagtccaaggaggagtccaaggaggagtccaaggaggagtccaaggataagtccaaggaggagtccgagcctgtggcggtagagcccgaaaagaagcctgagcaaagtcctgaacaggcggaggaggaaaagaaaaaggccgacgagctcaaggtccaggaggaccgtaagaagaccgaggaagacaagaaggaggaggaaaagcgactcagagaggaggagaagaacggccgaatcgaccggctggcggaggacgaggagcagttcaagaaaacagaggccaaactcaaggcggcggaagaaaaggcaaaggccatgaaggaggagctggaggaggcacgaaaacgaaaggaagagagacgaaagaaggcccaggagcaaaagagtgaaaagttacagggaatcttccacaagctggaaggagaggagatcggatccatcgtcaacaagcctctcacttacacggacgaggagaaagtggacggtcatgtccagccctacggacccaagattgcgcttttgtctgcatccaacggaaaaacggacaacgaaatggccatgctggaactggtgctacccaaccgacaggagtactgcaactaccacggctacatttgtgcgtttgtggatctcaacactgtcgacaccggttcggatcacgtggtgtgggccaagatgggtgctattcaacgtgtctttgacgaacatcccgaagtcgagtgggtctggtggatggacactgatatcttcctcatgaaccccgagatcgagcttggtgagcatctgctgagtgaccgagctctggtggaacgactcacctacgctcgtcctattcgaaagcccgatgccacctttgatggagaagtctacccttctaaggacaatcctcccaagcccgagaacctcaatctgctgttgacacaggactttttcggtatcaacgccggctcgttcttcatcaagcggtctccttggacagacatgttgcttgatctgtggtatgaccccgtccacgtggagaagaactacatcttcaaagagcaggaggctcttaacaacctgattcgaggccacaagtccatcttgtcgcacactggaatctatccccagcgtctgttcaattcgtacactggtgagcccaacgacgtgtggacctacaaggagggtgatctggcactgcatctggccggctgcaaccacaataacgactgtgagaagcatctgactggctactttcctcagagagtccgggttcctgagaagtacagggagtctggacttagagtggattttggaaaaaagaaggagggcaactaagcgaatagcccacaagccaagagtgcaacaacacgaagatgggcacgaagagtacccttacttttgcctacttgtagttgtactagtatctttatccaaagagcaccaagacaatgcatcaaccgttctagagcatcattagaagatgccattagaatagattaataaaaggatattattttgtaactagtgagtgtacttgtacaagaagttgaggtaatacaaaaagatcaacaattgcaattgtcttatggtcgatgatgactctccaatctcaggcatcagactctgggacaacactgtggctccttcactagaagaattggacgaacgcttgtacacatggaattggaagcctttaccacatgatcgtgtttcgggcccttaaaatcttctaacagtacttgtaccagtatgtttctcacatagcttttcaacatggcccacaatttgaatcaactagacacccaactaaaaacatgcccccccctaactaaagtctaactatgcctgtcccaaaactaggctgtgataagcgcaagtcactcttggcttagattaggccggaagatgtcgtgtgcaataatggcgatagtggccaagaaaacacaacggggatcttgctctctaaacccctcagtagctatagctatcatctcatcaaatgcctcggagatatgcggagataacgtagtgagggatttatgcagcggaagaatgcacacagtatcggacatacatgaccgtccaacgcgtgaatccaacgtcgcagaagagacaagagtggcggtggcaataaattcgtggtacaagtagagcggatagcgcgattaacaaaacagacaaatgtccgattactaatcaatatatatatatatatatatatatatattacctaatcaacaagggtttgggtgcccccctgtcagaagcgagacagcagtgacttggcatcatcgtataggttgactggtccaattcagggtcatacaaagagccttcaatttccctgtttggcgataggtgacgacgaaaaccacggaaaacgggggttcagcgcccatatctccgctaaatccgaagtaaatccgatattgatttttttttccgctcccaaaaggtggactggtcgtgtatggttacacttttggttactgtacatacaacagtagaggcgagttttggttttggttcgagcttgaaaaatcacacttcgttccacctacacgccacaacacatacagcccccttcacacaacgacaatgttacacgtttacgtcgtgcttctgttagcggcactatgtcacgcgttctatctgcccggcgtggcccccacagactatgaggagggcgacaaggtgcctctcctggttaacgcgctgactcctcgacagattctgtccgagtccggtcagctggagtctgttgttccctacgactactactacgagctgttcaacttctgcaagcctgtcggaggcgccgagaagcagagcgagtctctgggatccattctgtttggcgaccgaatcttcaactcgcccttccagctcaacatgaaggaggacaagcagtgcgaggagctgtgtcccaatcgacccatttacgacgtgttctccgctcgtttcaccaacaagaagattctgcaaggttacgcgcagaactggttcatcgatggtcttcctgccggccgacagctgcgtggccaggagggacagttttttgccggctttgagctcggagagattgagcagccaaacgccgacaacaccgacgacgtggatgactctgagaacaatgagaagcgagacgaggattccgacatcccctacctcaacaaccactacgacatcactgtggagtaccacaccaccaagcagggcaagcaccgagtggttggcgtggaaattctgccgcgatctctcgaccgatccggcgccgaggaagacctctgtggtgactaccccaagctgcatctccagactgatcccgatactaagcagcaggtggttttcacctactcggtcacctggaagcactcagacaccccctgggccacccgatgggacaagtacctccaggtccacaacccccaggtccagtggtttgccatcatcaactccgccatcgtcgtcactctgctggctactactgttgctaccgttctgacccgagctctgcgaaaggacattgcctcctacaatgagattgatctgtctgaggaggttcaggaggacagtggatggaagctcgtgcatggagacgtgttccgaactcctaagaaccgaatgattctgtgtgcctttttgggttctggagctcagatgttcgtcatgtgcggcctcacagtcttcttcgccgtcattggattcctttcgccctccaaccgaggagctcttggaacagccttcattctcttctactctctgtctggctttgtcgggggctacgtgtctcgaaagttctacaacaccatgggcggtgagaacgtgaagatgaaccttcttctgacccccgtgcttatcccctccatcatctttgccgccttcattggtctcaacttcttcctgattgcctacaactctgctggagccgttcccttcggtaccatgcttgctctggttgccgtgtggttcgccatttctgttcctctgtccattgctggaggtttcatcgccaagactcccttctctgtgcctgtcaagaccaaccagatcccccgacagatccctcagcagcccttttacctggaaaaggtcccctctgtggccattgctggtattctgccctttgtggccatcttcgtcgagctgtacttcattgtcagctccatctggttccaccgaatgttctacatgttcggcttcctgttcctgtcgtacggtctcatgctggtgtccaccgttgttgtcactgtgctcatgatctacctgctgctgtgctccgaaaactaccactggcagtggagatctttcttcattgccggctcgtgcgccttttacgtgtacgctcacgctctgctgttcctcatcaacaagctggctctgggctccttcacctccaacattctgtatctcggctactccgccatcatttccctcattatgtttgtgctgctcggaaccgtgggctacacctgttccttcttctttgtgcgaaagatctacaccgcaatcaagattgattagacaagttagcatggcggttgtaaaatctcccaataaaattttatgaatattactgagcgaacagcacagtagctatagacgttacagctgcattgctctcagcagacaggaaatatcgtatcgatcagctcccttgacagtgtataccttcaagggactgggtacactgtatcaacaactgtccatgttgtacttctaaagtacttgtatacatactacatatactacttgtagcactacttgcactggtactcgtactgtaccagttattcagcacactaacgcataatactctaacgcttccttggttacttgaacaaccaatccaaacactcatactgtagacggctaaattattcaatttcgatattttttttcatcttcggctcatccaggccacattgagtttgatgagttgcgtcagagcggtgtgtgcacagggataaaaaaaatattttttggatttgcgtgcagagctccctaatgattggtgcgcttacgtaactacattccgacggtgtgcggtgtacatacagtctgtttccaccgtatgccagtgtgtgcaagggggccaaaaaagacaatagggaaaaagaaaccgaaaaatacgggaaaaaaaggggctcaaagtaagtgcaagttgaaagtgagattgcgacggaattttgaagggggagggatattagacgacggggccgcggtagacttgccaaatcacgtgaccaccagacagactcgaccccccgcacgtgaccgcggtcccgtccctacgccagtgcgacgtcaattgctgtaaaacaccccggctctgtaatcgtaatcggtccttgtttgagtgcacagatgcaccccctaaccccaactctaatcgaaaaaattccaagtttaaattttctctcgctatctcacagtctcctcttaacttgtacctcactacacgatggacgacttcacggtgcaactagcccagcttctgggccaaatcacgtcccccaaatcgcctgaggacatcaaaaatgcgtctcagcgactgcaggccgagttctacatgaaccctcagtgtgccgtgtctctgatccacattatgcagaagcacgaggactctggaatcaagcagctggctggaatcgaggcccgaaagcagatccccatttactgggaggagaacgatcaggccgttcgaaacgagatcaagaactcgcttctccagtccactctggccgaacaggtggcccttgtacgacacacctctgcccgtgttgtggctgccattggagagattgagctgggtctgcagacctggaatgagctcccccagagcctcaacaccgcaatcagctctggagacgcccgagatcgagaggtcgctacctacatcatctacattctgcttgaggtgggtgccgagacctttgtgaccaacgcctccaacattcttcctctggtgtccgtcaacatggctcagaacgacgccgagctgcaggttacctccatgctgtgcgctggtatgatctcagagctgattgactcttccgactctaatgccgacatgttcaagaagcaggtggtgccccagatggtcgatgtgctcaagggtgccatgcagcgtgacgacgacaagaccctgcagctgtttgaggtcttctcaaccctgcttctcatcgagggcgctcttgtggctgatcacattggcgacctcgtccagttcatgctggagattgccaagcgaggcgactctgacgagaacaagatggccgctctacggttcctgatctctgccgtgcgattcaagaagcgacgactgcaggctctgggtcttgggcccactctcaccaactccatggtcgagatcattgcacagcagattgccgagttccccgacgagcaggacgacgatgatgaagatgaggatactacccgaaagcttgctctgcgagtcattggttatctgtccaacgagctgcctcccaagcaggtgcttgtccccatctttgagcttctgcagcagcagcccaactcggacgctgtgctttctgctctctcctacgccattgagggatctcccgagttcgtggccactcacctggaccccgttctcgagtctgtcattggcactctccgacagaaccccaccaacgtgtctgctctgatggttcttgtccgtctggcctaccacctgcaccacattattggtgagcaccacgctactctggtgcctctaatttgctctgctatggatgcctcttcttcccccgctcagttcaaggctgccacctctgccctggagtctgtgcttgagactctcgagcaggacgtcatcgccgagaagtacctggccgagctcatgccccgtctcatcaccatgctggaccaggcccaggacgactctctgcgaactactctgatcgctgctgttggttccgctgctttcgctgcgaaggaggccttcactccctacgccgagcagtgcatcaacggtcttggccagcttatcaacctcgagaatgccgctgagatgaccgaggtcgagctcgccgtcaagggctccgcctttgacactatcggcgcgattgccggcgctattggcaaggaggccttccgaccctacgtcaacacctttgccgagaaggcctatgctactctgcaggtggatctgctgcgagaggccggctttgttttctttggcgtcattgccaagctgtacggcgaggagtttggccagtaccttcctcgagttattcctctgcttgtcgagttcctgggacaggacgacttcggctttgaggatgaggatgaggatgatgaggctattggacaggaggacgacgactccaagttcaaggtcaactcgctgctggctacccagaaggagaccgctttccaggtgcttggcgacatgatcctcgccaccaagggccagttcctcaacttcctggaggagatcaccgatcccctgttctctgctctcgaccacttttacgagggtattcgaaaggaggctctgggcgccgtgtggaagattttccactctctctacagcatggccaaccttccccaatggaagcccggtttccctgcggacacctcggcctaccccgagtctctgtccaccttcctgcagcttgctcgaaccaagaccgtcgagcttctggaggaggaggactctcgactggtggtaattgccatctgcgaggtgcttgttgaggccatgaaggccgctggacccgccattctcggcgacgaggacaccctgcgaaccatttgctcccaggtgatccttgtgctcaagaaggagcaccccgcccagatggaggaggaggagattgacgctgccgagctcgagcagtccgagtacgactccctcatgctggactacgcctttgacgtgtgcgcagccatgtctgagtctctcgaggctcactttgtgcccatcttcaaggctctattcccttacgtgcagaactacgccaactccaagatggatgaggagcgagcctttggcattggtgctctggccgagatgactgtcggcatgaagtcctccgtctccgagttcaccggcgagattctcaacatctgcatcaagggtctcaccgacgcccatctcgatgtgcgatccaactccgcatttgcatttggtgtgttggccgagaactctactgtcgacctcacttctcagtaccctgccatcctccagaagctgcagcgcctgctcaccaaggtcgacaagcaggccaagaagaacctgtcggacgaccccgaggacaacaacgaccgatgtctggccaacgcctgcggttgtgtcgctcgaatgaccctcaaggctcccggctccgtacccatcagcgaggtggtgcctgccctggtggctcgtctgcctctgggcgacggccaggaggagtatgtgcccatttttggcctgtttgccgctctgctggagcacaacgaccccactattgtgcctctcaagggtgacatctccaatctgattcaggagattgcccgaaaggacgagacagagaagatcctggacgaccaggtcaagcagaagctggaggcagtgatgcagaagatgtagaaaagtggctaggtggtcgagactatgctagatgatttaatagatgttttatttatacgatgtagaccgggctcttgatttgaggagctgaagataggagagcacaattcttgagccagggctgctctctcgaagcctttcgctttccgagagtcgtgtctactgaatccataacagaagctcacatccacccaagttggaaagcgctagtaaagcaggttgcagggacattattccagaaaagatttatttatcgcccgcgccagtggtatcagttgtattctgtgtctgcaggtagtgtcattcctatcgtatctagcgttgaagcgtgaatccatagagtgaagaggttgactctttaaattggatagaggatccgtgaagtaacatgaactgaggaaattggccattatatatattcttcttccacagtgcctccattcatctgtctttgaatgctgttataggtattatcgcatggtagcgttcacaaaggagttgggagaaggtccacgattctgaaataatatcaccgaatgtcatgacgatatcgaaagatacaaaagaaaaaaaaatcacaagtatgaaacggttatcgttgctgtatcaacagatacaaaaaaaatggacgacaccggaatcgaaccggggacctcgcgcatgctaagcgcatgtgataaccaactacaccagacgccctcgttaaaaacacggatttttggcatccactttcagaaatgttgaaaaatagaatgaatcattagaataaaaaaaataaaaaaatgtatgatttattgaacgccaataacccggcttactacttgtaggtatatagctgtaatgaatcattagaataaaaaaaaaaagtaatgaatcattagaataaaacaaaaaaaacccagcaaaaacaaaaaacgagggacgtttttgaccgtttcaaagtgtttcgagggtagtagaaatgtagaatataaacacactactggtgtttcttacgagtatataatattcatgttttaacaatggtattgatggagatcaatgtttgttgttgtgtggtaggggtcgaagagacctctctcgactattatcacttcctgaagtgaccatcaaaagactgcaagttgaaagatgagttttaaaagataactgaactgatgggggaaccgctttcatctttatgaggtcgaactaagtggctcccagacaagtaccaagttacgtcaaggaaccatctgagaaaagatcttactctcagtgatacagagggtgatacagacaaatttatgatgtttatgagactttctcatagagcttgagtgacgcagacaatgtggtcagtttgtcaccttccagatcaacttcttcacttgaagatctgtgcactccttctcccagccctcaggttggaagaatgtcgtctagttgattcaccgctcctggcgacaatgcaggcacagaagctggagcctggggatctaagatggggtaacaaaaagagctgtaaaagaggcaagtcaactagcgcgtttgactggagtcacacactttcccgtctcacaactcctacagctatgcggtctctacaggtgtccccgggctgtgctactctcagtaagagttgaaatgtattagattagtataaataaatagggagcatggctcttttgtatctgctgcccccgtacagtagcgttatcgtttgttgtttttttgaacggggggttggcgggtgctattcgccattaagtctgtatcgtgcacgtctctatcaaagaaagacgttcatcatggaatagctggtgaagaccatccagagaatctggaccacggcccaaacgagtggaatccatgtactaacactacacagacccgctcgatagactcccgtgataatgagtcccacaatagtcccgctaactattgcctcaattccggcaatgccaatgtacagaaacatgattatgagtccgtttttgaagtcgcgtttcaccagcgacgcccacattcccgcaataaagtggaagcagcagaacagaatgatggtccacagaaccgtgaaccgccaaatgtcatatgtgtaatataatgacgagacttcataaagtcgttctgacgatcctgcgggccagtaaagagacggaaatggtggtactttgtatccgatcgggacgctgtacgtcgacgatatcagaagtctgtgttagaagcagtggaccgaagttggcggctgtggcagtactcacaccatggttcatgggtctgttgcgatgtggagagatgttgccagtggctgttgtgcctgatatttagttcacaaccttaaattaacgccttacagaaaaatatctttaatttatgacaattagttgggttgttagttggtatttacttgagaaaaatggagaaagcacacgcataaagtgtgcgaataaaagttgtaaataacaacggtagtaataatcaccgtctatccacatctcatcaataaattacaatcggattcaaagacccatttctcgcatgacggccattgcctcgtcatcctcgtagtcttcaggatcaggttcgggttcatgttgttcctggtcctcgaaatcaggctcaaagtcagccagcatgtccaactccagatcatccatttgtcgcatcggctggggtggcgctttaacgggtgcctggttggagggaggttgagttggagcaggtgcctgaggaggttgtgtagctggtggctgagcagcaggtgcctgcgtggaagtctcagatgcaggtggaggagtggggtctagagaaccagtgccgaatatatcaccttctaaggtactgcctccacgatcactctcagaggggctaccactcccccccagatcaaatagactcagtcgtccggacgatctcgaattgtccttgtcacgctgggctcgagctccctccaatagctcgctcacgtcctgctctctatcttcatcatcctctcgtcgactaacctctgcctgaatgtcaacatcttcgtcggataccagtcgatggtcaacactgtccatacccacaaacaggtcgtcggggttgtccacattcacggaagtctccacggggggttccgattgcctactgtatcgaggctctgtttcaaaatgtcgtcccctatctctgaagtctgtaatgtcctccagctcatcaactgcagttgcaacatccgcagtctgtttcttacgctgttcctcatcgatccaagcaagtcgcagtccccgcacagttgcagttcgaccggctttggacgtcagaggatacaagctcttgaactggcccttgggaaacagatcatgcgaccacatctggtacatgtccagtagtcgacccagatctccaacctcgtggccattgcccttcaaatttaccttggtacacaaatgcttgagagcgggaagccccttgtcgtccatcatacgggtatcgtctagtttcgccacatgccgggttctcttgacttgcacttcagtattgattccaagctcgtcatcgttgagaggttgcgaatcgatattctgcgagtctgcaggcgcctcaagctgcgaaagaccccatggcgattcgtagtcgttatccatggctgtttttgtgtgatgtgagtgggtgttgtgtgaaaacgcgtcaccgattacgcgtgcacttaattaaatttcaacgtgcatgacgcatggctgatggagaaaaaatataccggttgggttgttaattactagtaggcaatcagtactcgtacttatacaagtattgatcgccaagaaaaggacgatagatgattgaaaaataccacaatttttgatctacaagtctagagttaattatttttttcgaggtattaatcgacattaaatttggaaataaaatgctgtaaaattggaacgatcatggaaggcggagcttctaatatcaacgccgccggggattcccattatgctaccaaatacagataaaagaaaagtcgtaattcgttagagtataatacaatctatagtccgaaagacatgagtctaccaagaggcccttcgcttgtctttctcagtgtctttctcagtgtctttctcagctagcccccgaggaacccagccaattgcctccaatcgctccttcagcttggagcgaccggaaagatcggtcaaccaaagagggtctccatccagaggagacacgcgcttataggccgacgaaagcgtgtatccatagtaggacaagtgtacattgccaagacagacaagtccagcgtccttttgaaacgtctgagaccgtttccagtagttgttggcgtactgacacgccttgtagatggggtagtgaatgcagggaatgatgtatacagccaacaagataggttgccacctcttcaagcccaggtacgtgtgaaaggacggattccaacacagaagcagcgtcaacacacctcttgtgtattccgatagtgccatccaccccagagggaaagtgtctgtgttgatggggaagagtcgccctgctagcacatgggccacaaacagcaagatttccggatgtgtgtgcattgttagtagatgattgtggatataaatatgggtggtttttttggtccatcctgccacgtgaatccgtggttttcccttgtggtagacgtagatctgtgttgggttagggaagttgaggtcacgggccacattttcgagcttggaccgtaactggcattccatgagcggatatgcattgggcggcggacttgtgcggtggattttgagcaccatcatgtgtgtagctgtgtagatcagagggacaaggaagacgagagacatgtggggctttttccagggcaatgccgatactgcgagctctgcgaaccccacaatgagacattgaacgacacccttttgcagagtttcggacgtgtactcggacaggtattccatttttgtaatgtgtagttggagcacgtttgcgtcgcgttcgtaggcatgtagcagtagcgagatgcgttggagaatgtagaaaatggccgaggctagaaaggcgttgacgcagtcgctcagtgccatggtaatgagggtctggggcgcgtggatttggctcaatcgcagtctgagccggccctggatgaactcggacgcccagatgatccagggcaagagacctaagccgaaaatggccgttttttccacaaacggcagcagtgccaggtagaactggctgcgcagctcggcccacgccagctggttctgtttgcgcagccccacacagtccagcatgtgtgtcaattcagggggcaccgtgtgggacgcgcccagatagacgagctggcgcgcctgcaacaccatttcggccacaaagaccaccgcggtagcaaccacaatgagagtgcccattgtggaggtgtcgatagaagcgaggacgggggaggatgtgttgtgttactggttgatgtagactgaggttctcggtactagagtttcggcagagccctgcataagctttagtggggaagtgtggagagtggagcgtggggtgagtgggtgtgtaatgagcgacaagttgacggcagagtgtgtacttcgagagtcagtgggcgctggatgcatcggtatatatatattgaggaaacggttttaatgtcactttgcaacatcccagatgtaatcaaaacgcacatcccaaaaaaatcgggtcacacctcggatcatctccagcacatgaaagcatgaaagcatgaaagttggtgcatgaccaccaatggcctggcagatgatgacagggtacgactgttaatggagatgatggttgtgaatggtggaaagcgtagccatcgatagaagcaaaacatctgaccaagtgtcagatatcctgtcgccatgactgttatggcattttttttaccaactgttccgttggctcatctctcagcctgggtaacgtcacatggatgatataagagatggatgatataaaagagattgatgatataaaagagataaggagcgcacgagacgttttcttgggagccacttcattgtacgtaataaccagcctcttggaaaagctgctatgaacaaaaaatcataattgaatcgagttgagccagagggcgcctatagattgtattaggggattcgtaggtgttgcaaggacgggtgtacgagtctagaatctttcaataccaaggattgcgaaatgaacaactgatatcgcgaatctctggtttgttttgcagtcacaatcgccctacagctactcaggctgactctcagcatttggtaagtcctaagcctcttccggttatgatacatgagcataaaaaacaaatccagggtggcattcactttccatcaactgtccaatgacatccaatatccaagacagttttcaactcgacttgtccaaaaatcgacttgagcggtggacgttgggtttcttgtggttgcattatcccctcttagtctggggctacttgcactacctgtggtacgagaatggtagcgcctgaaagagtgttattttagcgtcaattggataaatgcatttcaatattatttattattattatgtattattgttgttattgtcaggtatgtgttcgcatcaaacacctacttgctacagtgtgtattccacggtgcccctccagaactccagtatgtagtgatgtgcacttggagatgcttgaaactagcgagttgacttcagaaacgactttcctggctccccatagaactccctataagtaaaagtggttattgactacgagtacggcactcataattgtaaatattgtagtcgcttgtctaaaactcctaaatgacgtcatggcccaccactgaaccctcaacggcccatcaatcatctaatcacacactacaaatgtagtacttccagtcggcctcttcagctctccgacgctgatcggcgaattccggtccgtgtttcaccgttagccgtgtcacggaagagatctgaataccgccaaccatcgaaattcttgcacccgctcttgcagtaaatacgtgcagatatgtactcaacctgtctacttgtaccgaagattctgcatctgcacctacttgtctggtttactagttggccccccaatggcccacacacacatccaatctcccaccttcctcattcattcaatcatacccccccattttcatcccgtgggtgccccacaacccaatcctaccgtgtctaacgtaaacgtgtattgaccatggtggggttacatacggacgtgagacaggcaatggagtggtgatgtggttcatgctgagtaagaaatgggatttacgcggtccaaattgctctgcgctatttgtagaacaaacatattgctctcaaacccctcacataatgtctacacccgccaaaacctgtacagactcctttcttcctcactccacatgatcaagtcacgccgtttcaatctcacttatggttatgcacaagcgagctaaatatagacgcataactaaatgtgagtgtgagtatatactgtttgtacagtatgtacacgacacagccaggaacatagcccacgctgcgataattgggacgtacagtcatgattatgagacttgaaattaccgcgcggcatactggaggcggaaataatcgacttttcatcaccacaaaatatccccattcactctcaatacacccgtctctaataaccgatggtacattcgtaacctacgaaccaacgacagtgtaacctaagatataccgcagagacaagtccgagataagaggacgcttggcagcaaactacgccacaggcagtcggggagacgccaaagcgcgccatgtcgtctgtccttcgcccacaccgcctctccagagagtcagccaagccccgagccccttgttttgcacatccaccaacaagctctaattaaactaccgacctagtagcgcgctagggatgcaagcaaaaaatctagctccggaggtctagcccgaggctggcagtttataatgttggggtggtgtctctggcgctgcaattgattccactcgacgaaaaatgggaatcaaaggctactttagcactatgagagagcggttcacgccgctgacgttggaccagatcggcaaaggtgttgtcttcgtggacgggcacatcatggcccaccaaatcgccaacatggttgatccaggcagccgttacgacatgcgtggcgtggccatgaagttggaggagctcttcaactgttggatcggccaacacaaatgggacattcagctcgtgctgtttgacggcctggtgcccacagacaaaatggacggcagacgcaaacgggccatggagtccctccccacggctctgcatgcccagagtctcgctctgaccgttctttgtggagctctgtgtctcgatacgatccagtccaagttcccaaatgtcccgtgcttggtgtctccaggcgaggcagaccgggatctggcctgtctggtcttcaactacgccaaactgaactccaacaaggccgttcacatcatctccaacgactcaggtttctgcgcgttcgactttccggaaaacgtgcacgttgtcaacaccctggtaggagggttggagaactcggttctgtatgccctaccagtctcacgaacagtcgccaactggatcggagtcaaacctaccctactggcatactctgtcatgaaacacagtggaaagggaccttcacaagcgaaaaagtacgaggaggaagaggggtacctagagttttcacaacagcaacaacagctgctagccaaggccagttactcatctgtaggcgaatatctcgccgaacctgtcactcgaagagcataccagatctttggccaacagcacgacgagctgttaatgcatacagctgcgaacgcatggatcgagtatggatacggatacgtgctgctacccgtcatgtgtgagcccaaggagtttgagtatgcctttgacgctggacgaaggtggcgatctgtggcgtacgagatctgtgcccagagactgatgcaggtgttccccgaaaaggactttgtgacatctcatgtgcgtgagtttgtgcggattggagaaacgttaggagagatggacgtgcctattaccgaccacgagagagcaagatacaacaagaccggttcacattaccagctgttccaaaaggaggagcttttgcgagcggtcaagacgtggaagacttcggatctgatcaacgccatttggatagaaatcatggccacgtctcccaacgtccgaaacaccaaacttgaatttgacgcccatcacatgagggatagggtggtcaagtacttgaaggaagcatggaacgacgagggagtgtttgctctgcgaaggtactcacgaaaggagcgtaagttgatggcccgcaagtcgtgcgcaatggaagcaacggatcgtcggttctacaacaagctgttggcctgtttccagagcttgcgaatgcttcaagctgtgggagtcacgttcccagtcgatgttcatttgtttgatcttgatggaactcgatggatgtctatgaccaagtcgaagtgacaaaacaaccgagccaagtatttatatatgtgacaatagatgattacaattttaacttgttgtacaagtatctctgagtagccgaagtattagtagatttttatatatgcatatattgtaatcgaaccaacaaccacacagccaaacgcacttgccctcacctcctcaaaccctaaccgcagtgaaaaatactgcatggctctgggccgactgggatcaagaaagctttcaaacacccgaaacacatacacacaaaatgcgactttccggggtgtctcgattcggcgcaacggtcgccaagttacagcgacctaccatcactctgcccaccaagcaggcctccggcatcgacgccaacaagtacaagggcgggctgcctctgcatcgacccttgaaccaggaagagcgagttgccaagctggagcagggcatcgagtctggcgacgcccatttcgcgctgggtaagcgggaggtgtggttccctaaggagcaggttattcttgtgcgacccaatgccaagctgaccccctaccaggcgtcctttctcactcctctgcacatgaacaagatggaactgcgagactacctgtacaacgtctacggtctgcgagcgctcaacgtgcggtccgtggttttccccgccgcatttgagcgagaaaaccccacccgaccccgataccgaaagcgaatgatcaagaagatgactattgagatggaggagccctttgtgtggcccgaggacactgacggctttctggccaagatggaggagtcggcaagagagaccaagaagctcatggacgaggtcaccggccttgattcccttgggtccagtcgagatcgaccctctactgcctttgggggaattatgggcccctacaagaaggccggatcacctttcgtggcccagaaggtggcatccaagcttggcggctccaagcgacgagaggccgaggccgaggctcagcaggagaagatgcgaaacatcgccttctacctggccaagaacaagcaggctggcattccccagcctaagacaaactagtctctgtatatagaaaggatatgttatgatagcaaacactgtagagagtgagaatgagcatgggaatgcagagaatgaatatgctcaacatgttacctattacgagcatactattaccatcacgtctataaggaaacattagatgagtgtacactgggttgttacagtacaactacagcaaagtgttgaacatgagttcatatcacaagtacagcagctagaagtacgtatcttacgaagtaatacttgacctgatagattgagcatgtacaatcgtcgatgctcacttggatgatctgcttaaccataaaggcgaaatgcggtgttactgtaaacacccaatcgtctacaaaggtctcccccattcatgtccatacctccaataatattatatatacagctaacgcgttccttttccttcgcatcgccactgtgcgccacagttttccttataagaaaccccggaaagagttgatcttcttggattcgctctttctagcagcattctgccatcctccccgccctcgagctcgtggccgagaagagtcctcatcctgagatgtagagtgcgaatgcgaaggaggctggggttgggggatgttagtagcagatgttgcgtggctgccgtggcctccaaagttcatgcccaagtgctcaactgcaggagaaggtgtcttcgagttgcctccaatgggcactcctcggtagtaagccgagtccgagccggctaaagacgctgacgactgcttggtggttctgtgggagttcccagaagactctccaatggactccacgtcgtaaccaagcagactcttttggttagtgttgttgaacagctcaccagcgccaggagacaggttctcggcctctgaagacgcggcgtatgttcggaatcgttcgtccagatcttggtaccgctgagacagctcttgatgactaactgacagctgatggtaccgattttcagcctcctgtttgatagtctcaagcatctcgagcaccttgtgtgagggctgagtctgcttttcaatgtttgtcatctgctcttcaagttctgcgatctcgcctcgcaaccgtttctccattgtttccttctcgtgtttcaggactcctaagtcaatcttagttttctccagctcaatgtgaagatctgagttggacgattgtgtctcggagccccgtatgttgtcggatgaagattcggcggaggcctcgaggcttttcagcttgtctctatactcgttaatcaatcgattctcattttccagagattcgaccttgagctccagctgtgtgacagcagcctccttggccatagctgcagcatacagtctctggttctcagcctgcatgtgctcaaactcgaggttggttttggcagtttcctcagtcagcgcgtcacactgaagacgcagttctcggttacgttttgtcagcgtaccttcgtgctgtaccttttgtgttcttagcgtgtttccgagctctttcatcttcaccaactgcgagttgagctgctcagactgacgcttgagcttttgattggatgtgacgaggttctgaacgtcaatatcttgtctaagagcactgtgaagctgttccttgagttggcggatgcggaactggttgtggtagtccaagtaacagacaaaatcaagctcgttcttgatcagcaatagctctcgctgataataagccaaaatatcggcctgttcggaagtagagtctcctctgagaatgggggaaccgacaggcaactgagttgggctcatcgcagggctggagttagttcctgactcaaggacaccctcaatagaggctgagggtgctcctagactggaatgtttctggtatcgagtcagtggagaaacaggactctcttctcgaccctgagaatcgctatcatcaagagtaagtgtggaaatggatactggaggaggaaagtcggcctttctgccgtacagagactggtgacgggcctgaagatccataagctgaccagtggcagatgtagatgtcaacgtaggcgagagcagctctccagcagcaacttgggactctgttgaagttgtcacttgactggaaggagtagattctcggtcagggattgaagtgattgaaaactgacgtttcgactcactcaaagacgtacctcgtgatcgagtaacaatttccttgtccttctccttgtccttagttccggaggatacagaaagattgtcttcgcgtgatctttcagcgggcgatgctgtcagaagagacaaacacaatgacgcaatgtctgcaggtgtcattccagcccatcggtactcatccttgagttcttgctccgacgaggatgtcagcagttgaacatgcaacaagtgtcggtcaaagcaagttttggaccgctgcgaaataaaatattcgtcccagtcgtcaggagacgacagagtctgtgaaatgtactctgtaggtttccgtagaaacatgatgaaattggaaggaaacagtccatacagaaaagtgaacattcgttcccagtctgggctgggagcgtccggaacattgtcccggggcagagcgtgccagtcggcaaacacagaagttgagttttctgtttctttgccaccatctgtgtcgctggttggtggatttgtgtttgtgtcgttagaaggttctgggtccagcgtagactgggtttcggtctcttctttttccttgtatttagcgctatcctcgtcgtctgtgtgcacctcttcctcttcctcttcctcctcgtcattggctactccaaaagcgtcttggttgtcgtcttcgtcagttatttctccttctctccagcacaccatgcgcccgtagactgcaaataagtagggcaggtcggtcatgatcttactgcagataaaaggcagcatcatgatgagtgccgaagcagccatggtgactacctgcgaggacttgtcgtgcaacaggcatgcaaaaaggtgcttgacgagctgtgagcgggccagatccgccggaattttggccttggtttgggagaaaaaggcagacagaagcacgagaattctaacacggtactcaggctgtacaaagaaccggttggcaatgacacaaaactcctggggccgttcttcggcgaatgtgaggatgaggtttttggcattcatacgcacaaaccgaagacgttcctccttcgcatcagctttgcccttggtctcacccacaatcaggctctcatgcaggtagatttggaccatgaagagggccgtgcttcgggagatggcctggtactgcgccgtattgccctccacgctgtctctgggcaccatccacgccaccagcaggtcacgggcagcccgcacgagatcattcttttggccggcagaatcaatggcgggcttggagtacaaatcgacccacgttcgaacctgctcctccaccaccagacagggagccaggcggctcatacactgcaagaagagcacctcagccgctgggttggccatgacggcatctttgtaaatctgaacgagatcctcgccgagcttggccgactcggattcggaaatgggcaggttggagtccacgaacgcctcacattgctggaccacctcttgtcgcacctgaggcgtcagctggttgggcggagtctccaacgccagagccatggctctagccaagtcgtgacggcgcctgtgttagtttttgcctgtcataaaaagctcttcactcgtactcacattcccatcgagttgtagatttttgatgaattcaagattggcttccccacgcaatttcactatagtgcgcctgggacccagtattatggcgtgcatgttctgggtctccgtccacagttcgattcatggttgggttggtatttacatcatgaaaaatataaaatatgtgtgtgtcccaacatgctgaatataagtacagcagtatgcaagaaaacataggacaccaaacgcactctcaacaacaatgagcctcctggaaatcatcaaaaagtgcgattcggcaccatacacgccactgactgactattacatcttcactgctcacgaaggaacgcctttgggatacctgacgcctcttgtggtggctgaattgaagaaggaaacagatacggtctcggtggacgaccacaagaagacggtgacgattctggcgcaattggacacgagtgagaagcggtccgaggcattcgagaaactgggagacaaatggcgagcacaaaaactctttgatgtactggagggttggagaaacgagaaatatgccatctacaaccccactggaacggtctactttctcatggagcgggctgtcactgccctgtttggtgtggtgacttatggagtacatattgtcggttttgtacctggaaaaactgccaaagatgctcggatctgggtgcccaaaagggcgcttactaagcccacttggcccggatacctggacaacacagtggcaggaggagtgggataccctgcctcgttgtgggagactgctgtcaaagaatgtggagaagaagctggtttagagccctcttatgtcgagcctcgactttcttctaccggtgttgtttcgtacctctacagagccactgatgatctcagtgacgaactgtctgtgatccagcctgaagtggagtatgtgatggatctggagatggacgaggcgaccatccctgctcctgctgacggtgaggtcgagagctttgagctgctgtctgtggatcgggttctgacgttgatcaaggaaggtaagttcaagcccaacactgcgctgattacgattgattttctgattcgacggggtgttattggagttgagcagcctggatatgtcgacattctctgccattcccacagaaagctgccttttcctttgctcaagtaggggaaaatgtgcttgatctagatacgcgattctgaccatacatggaggagttgacttgaacatgttaaaaacaaaccggacatgggacatgtgaaagtaaaaggcatcgcccaaagaattgtcagactggacaagttgaacaagtccagacagacccgaacacacttcagactggacgatatcagactgactaagactgaactcgatacttgaaatgagatcggtgagacttgcaagtatttgtacaaataatataacatacatatggaagataatgtatcactcgaaatgaaactggccattcgcggaaatgaacgtaatatctggtggttcggctaagcccctactctcgcatatgtgtcttgagcatgtgcagcccgaggctggatacggaatacgagccgtggaagccggttagaccgcccaaaacaggtacaagtactcgtagggttgctcatgtgaaaaattttcccctgagatccgtgtctgattttggatttcatttccgactctcatttcctgtcgctcgttttttcttatctcccgggtcatggctgcttgtcgatcggagcctattgatccaggaacaagagcctgtgtgcttagagcatgcaggggaatgggggttggggagtcggcctttgataagcgtgggggtcggttgacgctcagtggttcggtccgctttcgagcacttcaaggttgcgctggagatatcgttgattgagaaggaatccaagcccactgcggcggctatattaatccgaaaataagactgcgatagagctggagataacgttgcccagccaaactacaagtaacgcacaaggacaagatatactactgtatgagaaaggctacactcacagcacagatacagtgaaataccaacaatctattggttgacattagggagcactgcttgcacgctttgcttccgtcctgactagcctgtcggggtcgcaaagagcaacatgggaggcaaagtcgcggccccatttttccattccacacgtggaacacttgattctgacatctctctgcatggctgggggcagcggcggaggagtctcgtgcgactttggggctgggtgtgatatcgttttagtcgctccacccagttcttgtagcggtgtagcggtcggtggtggtggtagttggagataccaggtccgcccgtctggcagcatttccaagcccagcctcattgttgtttgagccccattattccgagtctctacggcagactgatatgaccggtcttcttgactcgttcttatggccttgtcgtctcatttaaccaacagcttccaaagtacatgtgtgattacactgcaattacaatcctcactgagaggggtatttgtaccaagttttcaatcatgtccgatgcgcctgaaccactatacaatggatataataccgtgggtggacacctgagagacacacgtgtgtgcacacatggttgtgagagcccctatttgacgtcatagaccccaggcttcccctcatgctaccgcacaagaggtcccttggctcgtctacgacctggggtaggcacgtccggcttttcggtcttattgtggggtaagtagacaagtgtttcggatttggatttccgtaccagtagacagtagaatatggccggtttgtaggtgaattggagataaggaacacttggaagagcacgcgtgacagaccgttgcggtctcttgacagcggattggatcgcatgtagttgcatcaagtcgaccacggcaagacgctgttctgtccctggcggagccatcataatatcgtcataatatccgcatcttctgcccctgtcttgtagctattgctcaaggttccaataggttagggcaatgcggcagcagtaacaattgtaacaaaaagtttactcaagacaagtgcaaaccaaaattaaaaaataaaaaaacccaagaaaaaaaaattaagcaaaaccgtaagagccagaaacagggccccaacagcagtagaggagcggggacatggctctttgggggtgcaactaaagaaaccactacatttttttggcttcccccggtggatcatgatggtgagacggcgccggaagaccgaatgacacggacatgactcaccgcaaccccctgattaacaccgcacgtttatcatagacggctatcagtgactcagtttggaccagcagcagagaattcaaacgtgcattattctgcgtatcgtggagctgacgtcacacagtttatgcagacgcgccctcccaaaacggagatgccgcaatcacacaccttagtgtgactattagaaaccgtgtatatataaatgacgcgcccccagaccaccatgtgccaccaaacctcctcgtctccacatcgccacactcaatcacaatatgccctgccatcacaaagagcccgtcaacaccgttgcccatgccccaaccgcagaccaggtcaagtgccccaactgtgactgtatcgtactgcaaatcgactaccaggaccaccgccggacaggctgtgatccccgatacaacgtctagttccgtctagttccgtctggttccctgcagatgtagcccgactccctacaccaccctcctccatgtcactggtgttaccgttttgcattatttattcgcatgctaaccgtcaatgtttactgggccaaccgtgcgacattgagcagctgcccacaccaactcaaggtgaaggtgaagccatggctcctcggccttgctggctacagtacgctctcatattcgcacagtactactttgctgctgcccatgcctatgacatcatcccgcttctggcaaacacaccattgtttagtgcagttgacctgcacggcccctgttaaacatgctatttattcaatctatttatttccagagtgcaccagcgtattgcgtgtccagttgtatcgcgcctgagcgagtctgtccgagtactgtaccgatacatatagctcagcctctccgtcacgctacacgtaattcactgtaggaatgcacttggtggtctccccacatttgccatttgctcttgcctgtccaaaaataaaataggaaagctcttgttcagtagatgctcttggcaaactctgaaaaaagccaccttcgacgtggagctacagagaagaaccactgggtgacgtcatagagctatagcaaataccccgtttctatacctgttgaaaaacacgctcaaaacacctctttccgagacctataaacaccttcctcctgtttgggaattccagggttaggacatgcatagtataatgaaaaacctatgaaaaacagactcgcaaccacgctctacacaggcacgatcgtagctcgctcatacgttagacatgccatctgcccacttttgagcaagctggcgccggagtcttgggcccggtctgtagactggctccattgagccaatctgtgcagctatttagggacagaagagatggttggacgtaacttatggcggacggtgtcacttctcgatacttgtacttgtagagcctgcaactgccgaaaacagccatctaagacgccgcaagaagtattcgacgaccccaaccgactagaaaaacgctgtcgaccacggataaccctgctcccgatgatcaatgtccgttttttcttgccttgtgttgcggaccagaaagttccgcattgcatggagcgcactgttatttctcgcaagacagtgatgtgggtttgcaacattgggccatatgcctgcgccgggcttggaagagcgagcgagtccgtcaagtaaacagagggaagtctgaaacgttatggctgtatggtgccataaaacctgattggggctgtttcaggttgtcactagccgaactcaccgaatgtactggcagctactagacaggacttgcgctctcaccggcctgtactgtagcgattcggatcgccgccatgccagcaaccatccagactgacgtcatggttcccctccaagccctgccctggtcggttgctatgcttgaacgtcgtataacagcaagcatgaagccccgttagcgtcgttccaaatatatctccgtgcatcccggaagtttaatcaacgggacaggcaacgttccaacggtgttcactgtggagtaatgtcaatgggaacgaaggatttggatttgttttcatattgattgatttgattgattgattgatttgatcatttgtttggattatcttaaaagtagtaccgtataccccaccctcaatctcaccccactcatcgccccacttatgtgcaatctgaaacaggcggagaagtgagcagctattgacggtcatttgctgtcgtacgagaacttgtgccaactacccaacaagacgcagaaagacgactaccagagcaggaaactaattcttggcagaagttgtctcgaaccgctgtatcgcagttggggtatagtgcagatttacttgtatcttgacgtcatagttttgacggctgcagtttaggactaatgctacgagagcttcaggttcaggcagctccaaaaatagtgcaatttaattgagggcatcttctgggtatgttatatctcggtctagcgtccggtttttacagtggttactatactatgggtatacagaggttttctccacaaacgcagctcttagtcagggaaagagcaacagtatagcactttgttgtgtgctcgtagtatgatcagactgaacaagttccaccacttatctttctactatcttcatgtcaatggtgtattcaaaccattgtagcaggtacttgcaatctagaccgtttggtacgatgctgtaggggtgatatcaaacaatacacctagacaccaatcatctccaactgttgctcatccaaaatatattattatacatgtatccatgacacaaatgttgcaacttacacgcctcttgttggtagaccatcggagtacatcctcggatctcgtcttacagcttggccttgttgagacccagaacaacatcgtcctttctagcacgcaacaatcgtcgcagaatcttgccactggcgttcttgggaatggcatcaatcaccacgatgccagcatgaagctgcttgtacttgggaagctgcttgtccagccatgttttaatctccacagcgtcgtacttcgggtccttgagcacaacaaaagctcggggagcctcgttacccttctccacgtcctgaataccaatgactgcggtatctgccacctgtgcgtgtcccaggagcatgtcttcgagctcggcaggagcaacctgcttaccctgactcttgatcatctccttggttcggtccacaatcatgtatctgccctgcttgtcgaccagagcaacgtctccggttcggaaccagtgtctgttatagtaggcagtatctgcttcagcatcgtcagccttgacgaaacaggcttcgttggcctcggggttgttatggtagccgtccataacctggggacctctgatccaaagctctccgactggcagagtgccctgtttgatggcctcgtccagctcgttggggtccacatcgtaggcgggctgatcaacgccgtcttcgttcacaattcgaacctgcgagttgggcacgagctttccacacgacctaatgtgtcgttccttgtcttcggggtcaaacagagtggctacgggagacgtctctgtaagtccgtagccctggacgattcgcagaccgccctcgggggactcgccaaacttgttgccagtgactctggtcaaaagagcctctgtgacattggcacccagaggagcagctcccgagaggatggctcgcatgtgggccctgagagaaggaatgtacttctcgacaatggggtgtttggtgagcagtacaatgatggggggtaccagggtccacgagttgactttatacttcttctgtgcctccagcacctcgatcagatcgaacccattgtgatagacagtggtggctccggcgtgggggttgccaatgaggaatttcgacagtccaaacagatgagacacggggataatggcggcagcgatctgctggtcagttgcgagggactcggaggctttgttagagatttcagaacacgacgtgagattggaatgggtgagcctgacagcctttgaaactcctccggaggtacctgaagacatgccaaggtacgcgattcgagttcgcgactcgtggggggccagcttgatctttcgggtgtgttcgaccttgtggtttccaaccattcgggcctgtttgtccagcgcctcgagctcaacaagtgcgggggggttgggcgagttgtacagcttcgtagcctcgtccaccacatccttgaacgccttggcatacacaacgaccttgggagtggtgactctgaactggtgagcgagatcctgggccgagtagcctgtggatccgggagaaatggttgctccgaggtcgagagcagcccaatggaccacaggggcgaggatcacgtttccaaaaaaggtgatgagcacatctcccatggatgggtccagctcgttgtctctgtgtctgcatagaccgtactgcgagcttagaagtgccgcgtacttgtccgacagctgccacatttccgcctgggaaagagtctggcctgttttggcatcgatcaccgaaggcttggtttcgttggagtggcctccgcttcgaatgaagtcggtgatcttgccgtcgtagagctggtccacggggatattggggatggtggcgttatggataatctgtgtcatgttacctggggtcttagggagaacagatcgcggtatatataagtggattggagatgaaccagaggcttctccttttgcgttttctgtcgggctgcactgcacggttaatcatgcggggcacaagtggggtagtaccagtacaagtattcgtacagtagctactttcaactaagttgtgcgccatatggcaagtgggatagtgtgagaaaaaataagtgcgttatatagtgtactggtggtctggaatgtcctgtgtacgagttttacgagtgtcggttcacatggcgcgttcaggccctgaaaactcccattcgactcgtcgtatgccaagcccacacgctaaggcctaaacccgatgcaaacggggttgatacacgcacaacacactcttttaaggggctcttccgagccgagacgtaccccgataaagtacaacactgtcttctgatggttggatgaggtggttaatgccgttctagacgaaacccagtcaaagtccatctaaatccgtctaaatccgtctaaatccgtctggtccgtgtactctcacctcatcaatgggaaacgcaaatgatacatcaccgttgagctaaggcggccgattttcttctcttctctcggactacttgtacgatacttctcttctccatctccgtgccgcaatgccgaggccgtttttgaaccgcctctactatgctactcgtacaatacgccgtttcttccggaatgcgtgtgtgcatccgacggtgcatgttgtgcattgtgttgagcgagtgttgggtgtgctgttcaatatgtgcactgtctgcatcccgttttgttcctttcccaaaaatcctctcctcttcacttctggctcgcttcttactcactttgcttcgtacccacaaggtactagtagctcattttgctgtggtcctctcctggctcatcacgtgatcccccactctcagttttggctttgcggctgattgactcgcaaagtgaaacagcgagcgtaatggagccagggttcagagggggtaatttcccatcacagcaaacagacggcggctggaaccgcttggtgctcacgtaagcggttcactcacgtgaggcggtcgagattccgcgccctccgtgtcgcaaaaccgtgcctacaccatgtcaggtgcctgtccaggccacatgaaacgggctggtacatccctgtaccccgcaaacctagatttgccgatctttggtatctatgccacagcgatatcgccaaatattggcgggtttgcggggcaacccagagattactcgagtccgttggccaacctccgagcgtttgtgtttgaaaacttttctttttgactcaggcacgtcattttcgctgacagccttcatctactgtacagccttgggtatgatgatactgtatcgtcagtcgagctgtgtggagtctaaaacagcgccaacgtgtgagacctacgatacaagaatcgactcgtactgtacgataaagctgctaagagatccagaacccgctgggacagtcgcctaaagcacgtcacagtcgtgtcggctgctaagcacgtgaatgggtacatgaaggagtgattattatgtgcgatattggcactgtcgcgtttggttttgcgtttgccctttttttcttgtcttgtcaaaaaaaaagtgtgtcagtcggtccaagagcttgtagtccagccagccttccagataataaaaggcccttaataaacgaaggacggcctacttttacgctgatcaccacaacccaagatacgacgggtcattaaaccataccaaccaaacacacgcgcacacacggactgccacgccagataaaaagcctccatgaacgcaatcacccctattctccagccccacatcgacaaggtcaaggccaagctgccaatagagaaaattgagcagattcgtgccaacattcccccgctgccctttgacgttaacaagctggtggaacaactgccgtcggcctccacctcggtggtcattttcgccaccctcgtgctgtttgcctcattccactctggatttctcttcaagtacgtgacggtgcccttcatctttgccatttgctgcgtcgtcatgctcggcaaccacaagatcaagtgatgcagagcactggacaaggcactacatgaactcgattgtcgtgagtctttgactgggtgctggaaaccatctgctggcaatcatcttcagtctcccacatcatcgcgcactcttacacacccagcaccaccaggtgtctctccacactgacgtaaaacgttccaaccaaaaaccgacatgtggtatcaaatgctacaccgttacataccgtctgtttctcattcagatagtagtttgaatatattcatctcgggattcgacctcgcaccaacattcgacatggaccgcattcggccccacccccaggtgtaattaaactgtatgcttgacccatgcaggttgggccagggaagtggtaatggtggtgctaggggatgtaatttggtggggattttcgtttttcgtaaagaaatagataattggcgttgatttgggcagaatggtggtttttactggatttattccactatttctgatttccaaggaattatgaaatttagtgtatgaatgaaattccaccgttgattaaggactgtctaatctacagacccatgccaaaatcaccgtctcaagaaacggacaattgaaaatattacaagtaaaagtacaagtacaagtactaaattcacccttgttacgtcacgtgaccaactaggtactatcttgtaccccgtaagtagtggtagtcgtattacttgagcttgcagaattatcttctgttagccgcatcagatacatgatctggcaagactgaacggtcaatcaatgattcgatccgcgagaaaaagataagttattataacaccattaaacccctctcgttgagctgattcagacggatattacaactcccgcaaataccgctcattggccaaatccgtcttctcgcaaacttctgtttttttttttctgcatatacattcatttatgttagttcgatgaaatctcgaaactctcccttagtgtggccgagtttctttggcttttttatttctttcgaaagtgacttgattcagaaacggacactaattgaatggctgctacagtacaacttctaacaatattaatacacaaccagtggcctctcccccttcacccaacaagtgtgtacttcagcccacgcacagctcagacgcgtcatgtgaaatgtcaaccctaaccgcgcatgtgaagctgtccgagctggttggctctctggaaaactctcttagaatcagatttccgaagaccagaaattacaatgtcctttcctgacaagattgttgccgacttcaacgtggattacgaccagaagagcctctggagtgagtaccgcaaccattggcgtccctcggccccctgttacacacacttgtaccccacaatcatgtgtacacggtgtaagaagctgatggaactaatcccctagccaccgatctagcaccccacgccagggccacaaccctcccttaaacataactaacacagtcgtcctgggctccatcgccttcaaccccatcttttggaacattgttgctcgagccgagtacaacacccactttctgactaagctggctggaggagccaagaccggatgctatctgctggccatcaccattttctcgctcggtatcttccgagactacctttaccaccaggctcttgagcagcagcccacctccattctgctgtcggtcacttacgttgacattgtcaagcctctggccattgtgctgtttgctgttggcaacgtgctggtccttacctccatgtacgccctgggcgtcaccggaacctacctcggcgactactttggcattctcatgaacgagcgagtcaccggcttccccttcaatgtgtccaacaaccccatgtaccacggctccactctgtgtttcctggcttccgctctgtggtacgccaagcccgcaggcctgctcatcaccgcctttgtgtcgctcatgtactccattgctctcaagttcgaggaacccttcaccggtgagatctacgctaagcgagaccgggagctcgctgccaagcagaagtaaaatgcctctattaggtatttactgataagcaacagaaaacggcctacgccaagcggcccttcaacaacccgctcacaactcaactatttatagcataacttatttcaacataatagattcaactcgctattacaaaaatcgatattttcttacagtatagatgttccggttgtagattcactaagttacttcacagctactcctcctcgggaccgtcaatgatgatcttgatggccttgccctcggccgccgtcttgtacgcctgctcagcctccttgaaggtgaaccggttggtcaccagcttcttgacgtcaatcttgccagaagcaaccagctgaacagccaggggatagtcaccatggcagtatcggaacgatccgagcacggtaatctcctttacaatgcatttggtgatagggaagttgacgtcatccttgcccatgccgacctgcacaagtcgaccggaagtggccagcacagaaacagcagtctgaatagaaggctcagctccggtgcactccaaagccacattgggcgagtcagagagaccagcgcccttgatcagagctcggatcttgtcagcagactcgttgggactgtctcccttagtgggtacaaacgtatgagtggcaccgaacttcttggcgagctccagcttctcgggaacaagatcaacacacacaatggtagatgatccaaaggcattggccactcccacggctagcagtccgactgggccagctccaaacacaataaccacgtcctgggcagtggtcttggccagcttgttgcagtggacagccacggacagaggctccacaagagctccctcctcgagagacacatgatcaggcagcttgacacaaaagtcctcgggaatgatgtagtgacgacacagagtaccgtcgtagggaggggtggcagcaaacaccatgcaaggacacaggttgtatcgtccctccttgtactcctgtgacaatcgagacggcactccgggctcgagagccactcgatctcccaccttgaggtccttgacttcaggaccaacctcaaccacctctccggcactttcatggcctagaaccatgggagccttgacaatgaagtcgccgattcctccatgcagatagtagtggacatccgagccgcaaactccggtctttttgactgccaccttgacggagtgggggtcctggatcttggggtcgggccgatcctcaaagacgagatccaatggctttcgaagaacaaatgacgggttagaagacatgttgagtgagatgaatggaactgaattgaatggaattggagattcaatacaagagtgtgagcttttaaagttgtccggaagaacccacttatgtagtatgtgtgcgcatctgcagtctgcgatgttagggtttgggtttagatcctttgcaagtggggatgacaccgagtggtgccttagatagcgcgcatgcgagcacaggtagctgcttgattaggcgtgccgcggccccttggatgatgttgattatgtaagcggtgttgtgaaagaaaggcactgccgaatgccgtgttggtttgtgcgtctcgtccttctcctccttcttctctattccatggatgatcattgtccagagtttcgttgggagcattgggtaccggtttaaggtgttgataagcttcgtatggtctgatggccacatgggacttgagagcaagtattgtaccagtattgtaggagcagcttgggggcaatagtagaatgcggcgggtcaacatgtctgacaagatgttgatgatgtggcactttctggtggttaacaattgttttgttttcttcctggtggcgcaatgctccattggctgaaaggtctgtccaatgtcacctgtcaaactcgtattcagaaaacagaccttgagacatgtggttttgggaagtgctgggaatggttggtcttataattagaggtgcgggtctggtgttgactatggcgtggttgttggtctcgaatggagtgttcaagggcgttgttctactattgtacaagtagagagtgtttgttcgtgctgtacctaccggtgagtggttgtctgaagaaggccgtagagtcaagtgttggaatcatcacggttacagggaagtgtttgagtgaacagtgatattggtgctgttccgcgtgccaattgaactggcgtgttttcagtgactctgttttgtactcggtattacttgtactgtacaatacccagtggtgcgaagtaggtggttaaatggactgtggagatgagttggaacatgagttggaacaagggagaggtcttgggctaaaataagctgactaaagacaatggttggctatgcttacttgggcaactctgaatgcttgtgttgaaaaaaacaatgacttgcaatgaccgaaagttgatggccatcttctctcaattcctgaggcacgctcactccacttctttcaaaagacccttcccatacttttttaattgtccaatacctgcgttatatattgcccgtctgtgattggcataaaggaggttacagtacacacatgagcagaataagtgcaggagaaccgattctttcgctgactcgtatgagaacatttcgtgctgcaactatgatgctgactgatcatcgacataggagactaggaaggtactgtagacgataagttgacgacacaaaagcaacgaaacagttcagaatggacagaaataaactgaagaaaccaatacatctcctccaacacgccccccgcccgctaattgctggacctgagaacctttgcggttctgactacagtagtcttccccagactgataaggttgacgtgcataactagagatgcaaaagtttagctacgcggtgataaccgcataaccacagagggacaagccagggaaaaatatatataagagatggcttcgacggacgaaaagaaggtcgctaagaccattaacgacacaaagacagacgcaactgtccccacaacaagagctgacgaagacgacgacgaaatcccaatgcttgtttcgggacctcctcctactggcatgttccagacccagagtgaacaccactacagcacattcgacgtgccccaggtcgaagaccgtgtgcccatcaccatcatcaccggctatctgggctcaggcaaaagtacactgctcaatttcctcagcaaacagaaggaaaagaagatcgccatcattctgaacgagtttggagactcggccgaggtggagagatcccttactgtcactcaagacggtcagatctttgaggaatggctcgagctcgacaacggctgtctgtgttgcacagtcaaagattcgggggtggcggccatcgagaacctcatgaccaagaagggcaactttgatctcatcatgctggagaccaccggagttgcggatccaggccctattgctaacatgttctggctggactctgcgcttgcatcttccatctacctcgacggaattgtgactgtgctggacgcaaccaacatcgtaaagtgtctggatgacgtgactgtcgacgatgcacatcatggggagaacaaggagcttcaaccgctatcgacagcctgcatccagatcgcccacgccgacattcttattctaaacaaggtcgacaagattggctctgccgaagagctcgaatatatcaagaacagaatcaaaggtatcaacggcctggcaccgatcatcgagaccacctatggacagattgagctgccgaaaatcctcaacctcaaggcctacgaagaaaaagtgaaccttgagcacgcacattctcacgatcacggatggcatgaccacagaatcaccactgtttccgttggttttcctcctgtttcgctgcagcaggctgaacagctcgagagctatatccagcaggccacctgggacaaccagttattgggagtgcccgtcgagatccacagaacaaagggtaagctggtagacaccaacggaaacgtccgagtgatccagggtgttcgagatacttatgatgttatggataccagtcaggtggagaatctgtcagaagttggacataagcatccttccaagctcgtcttcattggaaagaacctcagtaagcagctcgttctcgagagctttgcccgtttcatgggcattacagatattatttaaacagcaaccttcaaatacaatctattacattagataaagagtcaccgatgttacatgatccagttagtaatgagtatagttatctccattcaatattcgatgttagtattctctctatatgttatttacatacgtgaatgtctctctcacatcattctcttaccgatttctgactcccaggtagcagctcgctcgaagccgttgctgctgaactgatagtccatgaaggcattcatgattccttcctcggaagaagccacgaaaggaccgtgttggacagtcttctggttaagaatctgagctccaataatgatgattcgagagttgggagcaggggtaaagtcgatagtctcacccttggtagacagagtagcaacatcgtgagcatttatgaccttgccatcaacaatagcagagcccttcataacgtacagcagagagttgaatccagcaggcatggtctggctcatttctgttccgtcgtagttggattcggtgaagtagtcaaggtaccagacaggagtgtaagcaagatccttgacagagtccacgcccatagcctggcctgagattaccttgacagtaagatccttcttgtcggactgagcagtagggatctctgcggccttcagatctcggtatcggggctcgcagttcttgaggtggtcaggaagatcaacccacagttggattccttccacgacctgcacctcaccgtttggaccagctgcaggcatctctgcgtgaacaattcctttacctgcagtcataaattgcagatctccagcattcaaagtacccttgcttccagtaaagtcctcgtggtcaacagctccatcaatcacataggtgatagtctcctgacctctatggggatgatcagggaatcctgctgttgaagggaccttgaagtggtcaaacataataaaagggttgaagtttcgtagctttggagtaccgatggctcgtctgactcgggccccaactccttcagactgttcgggagctgtgaagaccttatcgatggccttggccatagcagtagtagcggtagtagtagtggtagtagtagtcattgtttgtctttttgtgaagataataatcaaaatgacgctctaggatgtcattatatattgttcctatctcgcgatggtgttttccagaagatcagtagtaataacttattgtgcataatatatgcagtgtaataagctagtaacaaagaaatgtgtcttaaacatgcgatgtaatgcatgtgtaatgtattacacctgggttattcagtcaaatagagttgaatattagaaatcaaccgttttgatcgtgtggaaggaggcgtaatgcactccataagatgaaagctagtagcataaactagtggaaggcattggatacagatagaaagtttccattgttggtggaatcgcaattataccatttaaacacatctcataattgaagaaataagagttagttacagacaattaatattaccatcaagaacggtatccaatcagctggaagtactgggggttgcggcacttgggagatccctgttgagcatagatagggccacctcgacaagtgtaaaactggttgactccgttccaggtgaaaggcataacggtctcctggttaccggtgaactcccagtagttgtaaacgaagggtcgaccccatccgtcctcagcagtaagcttgccttgaccgtcgacttcaatgtgctttcgctgctttctccagcctcgctcattgatgttcacgtttgagttatggtactcaacggtgaagtcaggacgcttgtacttgtcatcaagctccatggttttgcccttgatttcaacgggctggttgtggagacgggttccgggggcaaacgccttgagctcgtactggtagcccttggactcgggataattgggtccgctgttatcgggtcggttgtggtttccaccccatccgcctctctgggcagtgacaggagctgtcagggcaaacagggcaaaggcaacgttgagtttcatattggtcagaagtaattcgctgattatctttgtgtagtctagtatcatgtgctcattgatctatataaatacctggtctatattttggcgggactgaagttgctatggaaaaacgactgtctaggcaggtgcaagtttgccgtgaaatgcccgcagccccgttactgagatacacctgcagttgtgttgcagtagatgcaattgtgttggacttgctaaaccgagaaaattaccatccaaaccgctcggcaaacagctccacattctggccattgccccgtaactccgctacattatttctcacttgtctcaatagcatgtctggtccacagacacacacccaatcgcaagacgacgatcccttgagccgcgattgcaccatttcggtgatatccggtctgccctgtgtcttggtctcgtggatcaaaacagacgcattctgcacacgcgggtggctgagatcgacccatgtggcaaaagtgcggtcgggaacaatccagataaactcgacttcccgtttctggtgcgccagctgcagcatgagtgggaaggtgaaggccacgcctgatccgccggcaataagcacaatcttgcgctgctgcacaaggcagctgttttcggttgctgcaatttcctggggggcaggcggctgaaacaaaccaagaggcttgactccgtagggaccatggagaatgacggtccagctgatttttcgggaatcggcttcagacagcccgttggcagacatttgggccagcagcttttccttgagcgacttggtgaacccttttcgtactcggataatgaactcgaggttgtcttcgtgatcataattcgacgaaatggtaaagggatgcgactcgaaaagcctacatctcagaaaagtgatgaacatgtgctgccctgaatgccatttcagcttggtttgtctgttgaacaggccaatgaagaagttgagagtgtgaatgaggccgtttgtgatgaggatgccgacattcagagggttccaagaggacgggtagtagctcagtgagccgagcagctccctgggctggttcttgggaatctttacaacgatggtgtctccactgtgaagttccaggtatgctctagccactctgtatccatctgcagccctggccactctatcgtagacaacggacgctccagcagctagagcaaagggcttggcgatcggaatatggtagtacaagcccaccagtgacgcgagcatgcctaccagatgcacgacgtagaaaatttcgtaatggttttctctgaacttttgccgactagtcagaccaatgacgacgaaggccacgaaggccaagatgcccatgatcgaccagaactcggtgatcaagtacatgggattgaagtagtaggcgaatacggccgcgtgcatgacggccgcgtacacacagcacattccaaccacctggtggaagatgttgagttggtcataagaccatcctaccaggaaggacaggggtgtctttttggcccccaggatgtagagcattgggaagttgattgcaatgacgaatccggttctgaatccaaagacaatgaagtgggtgatgttgtaaaagagcaggaaggccgtggctgccatgaaaatgagagtcacgagatgcgtggctacatcaagccggccctctccctccgggtggtatagcagacattggtcgattttgtggaagatgcgtagtcgtccaaacagcgacttctttctgttgttgtgttctttcttctgtagcagtgccagcagcctgcggccctggtatcgcatgacgtgcagcaccagcaggcctgctagtgtccatgcgtagtatgtggcatagtctcgagatttgaagatggcagctgctagtttctccgtctcctgctcgtcctcaaacgggtttttgcctctccagatggggtacgagtttgggtcggagccagggtgggttcttgccagaatgcgtggcatggcaggggaggcgtcgaattatggtcgggagggtggcgggatgaaggatctagcaggagggacctgggtggaggaatctgggtggaagacactttcacttttcacacttttatcttatccatctcatcagacttttgggctcatccgcatgcgaaatggcccagtctgaaacctacagaggcaccgtggcgtccgttgacgcttgtttgcaactcaacctcctgtcgcgtggtgcagcaggtgcgcacagtatggagcaactggaaccatagctcgggggagacaaggctttggaagcaagtattggcatgcgatccgatcgataagatggcgggaaaagacgccggcaacactctacagacacgggccgcctctgagttagtctcaattgcgccataccctcgctggcagcccgatattgaactctgacaagctcacggaagcaaatttcacccgagttaaaagagtgtataaatttttgaccctggcgcggaactacacggtggccggtgcagccaagaaagtggccgtgttgctttccgtttttttatcggatgtggatctagacacgagtccgattgtgtcacttccatctgattgtccttgtccttgtacgactaatacttgtgctatatgtacgataccgctaagagtacagttgaagtcatgctactacggtatgtacttgtagataacatctgtggaacatctgattaaactaccgccagtacatacactattgagcttatactccgtcaaacaaggccccaaacaagaccccaaacaaccgatatcagactcatatcttagggatcactgtcaaagagacagtcagacacatgtcctcacatggacaattgtgtgaagaaatacatgtacaaaatggtggaacttgtagccagatctttcccaaacagctccgtatatttccaccaagatattcgtacaaatacctgggccgactgtggcctactgtacggttacatggtatctcacgtatcccactcactccttgttttggatgaaattcttggcatgattttttggagattttgaaatttttttatttacaaaaatcaaataaatacggatgaaaacggacattcaaaacaaccatcttccatttcaaacagactgcaacttaccagctgccacatgaacttcagagactttgagaggttggtctagtatagctggtctcaacgaagtaccggtaccggtactcgtaccgatactcataccgtccccggcagcaggttctgacatctctctacacgatatagtccaatcacgtgatgtgctctgatgtagttagtggggttagtcacgtgcttgtactattgcgtctgtctgtgttttccacgtcactggatggtcttgttgccgtcctcatgttcgattctccatcccaccaagtcaagaaggttatgtaatctcctctctcaagaccgtcttcggagtgtctcataagtcggcaacatctcggtactgtacctagcaaataatagctctctatatataccgctcaaaatcagttcaacaacgacaaatccgttaaaatatcatcaccgatatattaacgcaccccacaaacaaccccatgtctctccattgacacaatcactcacattcaacctgattagtggaccatgaagtgctgattagtgaactgctctccatgtgagacacacgattagagtggatcaacgtgacatttttcagaaccaaaaaaggctcctaaaaatgacggactaacgcactactacaagtagtaagtgtcgccacttctccgctccccgattaaacacggctatagatgcaacattggaattcgttgtggctgtgggcgcataatcatggcaatagacggcatgtggatccttgcatgataagacggaccaccgagattgcatgtaaaattaaactaagctacgagcttccttaaacacagtctctcacaactatagtttcagtaattgtccggtacatgtacgatagttaacgatatcaattaaatacattttatcccaggtgtccgagggagctccgagagaccaagtctggccagtttcaaccctccatggctcgccaatcaatacacacaaactccttatgcgaaatccttgttgaaggctcggccaatgagcattcgtcggacctcagaagttccagctccaatctcgtagagcttggcgtctcgaagcagacgctggggaacggtctccatcatgtagcccatgccacccatgcactgaatggcgtcaagagcaacctgggtggcctgctcggcagcaagcagaatgacagaggcacattccttggaagtgtgctggccgagatcagccgccttggcagtctggtactggaaggctcgagtggaggcaaaggcagtgtacatgtcggcgagcttgccctgcagcagctggttgtgggcgatgggcttaccgaactgggttcgggtgtggacgtaaggaagagcctcgtccagagctctgtgcatcaaaccaatggggccagcagcaagcaccagtcgctcgagatccaggccggacatgagcacgtagacaccgccgttgatcttaccaagaacgttgccctcgggcacaaacacgtcctcgaagatgagctctccggtgttggagcctcgcataccgagcttgtcgagctttcgggcgcaggaaaagccgtccatgcccttctccacaatgaaggcggtgattcctcgggcaccggcagcgggatcagtcttagcgtagacgaccatgtagtcggcgtcgggaccgttggtgatccacatcttggtaccattgagaacataacctccgtcgaccttcttggcggtggtcttcatggagacaacgtcggatccagcgccggcctcggacatggccagagctccaatcttctttccggcaatcagatcgggcaggtacttctctccctgctcgggggtggtgtgcagagacagctggttgatgcacagctgggaatgcgccgagtaggagagagcgatagaaccagaggctcgagacagctcctccataacgacagagtgggcgaggtagccgaggttgagaccgccgtacttctcaggagcagtcattccgaggaaaccagcctctccaaacttctcccatagatggttggggaaggcgttgtccacgtcggtcttctcctggagctcgggagtgatctccgcggcgcagaagtcaatggcagcctgtcgcagctcctcgatctcctcgattccagatccagagccgttggtgtctgtggagtagagtcgggcggcagccatggattgtcgggccatggaggccactcgaaccgacttttgcatgtgtgagagggtggatcgaagcattgtgtctttgtgtttggtgttgtgttagtgctgcttccagagggtcaaagcacgtatataaatatcccctggaagagtctcaattctaaaagctggggaagttttgagttttgaaatctgcatttcgatatccggggttttttcggcgtggtttaggaaggctagcggtggcctatttgcaaaaataaaacttgtgataccgcgttttgaaccattttaaatcgatccacgttgttaatttggctcccccaaagcccaatccctacttatactgctgctaccccaccccgaatttatgccgaacttaacttacggtttctgtggggttcccaataaccgtttagtatagtgtttataaatataaacgcggaggacccagtgtaacacctcacgactcttctgaacttcacctcttcccacacaacaatgcttcgaatcaacctcagagcactgtcgcatgtccgacagcctctagccaggcccctgggtctctcccggtctctgcaccagcatgtctctcccaaacagacggacttcaacgtgatccagtctaagattgatcctctgagtgcagactttgccgagaaaaagaagggtttcgaggtgcttgccaacaagctggccagtatccatgagcaggtgactgatcccgccttcattcctgagaagatcaagaccaagcatctggccaagaacaagattctccccagagacagaatcactgccctcattgacccaggcacctcctttgtggagctgtcgctgctggctggtcatgagatgtacggaaaggacaaggtcccggccggtggcattatcaccggtctgggccaggtcaatggagtcacatgcatgattgtcgctaacgactccaccgtcaagggaggaacctacttccccatcaccgtgcgaaagcacctgcgagcccaggagatcgccatgcagaacaaacttccttgtctgtacctggtcgactctggaggagctaacctgccccaccaggctgacgtgttcccctctcataaccatttcggccgaatcttcttccagcagtctcgaatgtcttctgccaaggtcccccagctgtctctggttctgggcccctgcactgccggaggagcctacgttcctgccatgtctgatgagtccatcatcgtcaagggcggaggccacattttcctggctggtcctccccttgtcaaggccgctactggagagattgtgtctgcggaggaccttggaggaggagagatgcactcttccgtgtctggtgtgaccgattacctcgttgagtctgagcaggagggtatcgagcgacttcgagagtgcgtcaagaacctcaactacccccagaacaacggccacgtgacttacaaccagacccctgcccccattgaagagcctctctacgaccccaaggagcttggtggtattgttggagacaacctgcgaatttcttacgacgtccgagaggtgattgctcgaattgtggacggctcccgattctccgagttcaaggccaagtacggcgagtctctggtgtgtggttttgccaccatccacaaccacaaggttggtattctcgccaacaacgggcccctgtactccgagtcttctctcaagggtgcccacttcattcagctgtgcaagcagcgagacattcctctggttttcctgcagaacatttccggtttcatggttggttctgaggctgagcgaggcggaattgccaagaacggagccaaacttgtcaacgctgtggttggctctggtgtcgagcgattcactgttgtcattggaggctcttacggtgccggaaactacggaatgtgtggtcgagcctacgacccccgattcctcttcacatggcccaactctcgaactgccgttatgggcgccgagcagctggcccaggtcatggagtctgttcgatccgagaagggtcacgccgacgctctgcgagagcgagtggaacacgagtccatggctgagtttggctctgctcgactctgggacgacggagtcatcaagcccgaggacacccgaaagtacctggctctggctctggaggcttctcgaggcggtgttcgacagaaggaggacaccgactttggtatctggcgaatgtaaggggatttgggcgcaggcatgtatttaggactagaataaaatgattataaggaacgaaccgaacgaacttggcggaggtaagtgagtggacctattgtgcgatctcaagcacgagtgcatactacttgtacaagtacaagtatgtgctgtatgtaaagtagtaccagaaatcaggtttatggtggtagagaagtaaatggagagtagctctgacaatcagggcttcacgaacttgctatagaaccgcgattccatttttttatcatatacaaggcacgattagtaacttttcaatacttactatcgtacagttcgttttctcagcagcgcatgatcttcatccttaaagactctctgggcagtgccgtatgaagtgtgttaaggtgagatggaggacactgtcaatggcatttgaaccgcaatagataacttcagactccgttatttaatttcacgtttgcctcacgaatcccattttctatttcacatgtcatttttgccaccttccaacagagtactttcacagttcaagttagcacatgggtggttatattttatatttcacactccgccacctgcatgcgacgtacataaagttggttatcgccacctacaatcacgctataagagtaagcacttcagcaacccaaccatgagtgagtcaaacagctctcacgacaaggatctgctcaatcgagacattctcatccatcacgtctttcctctgctctccccggaggacatcaagaacgtttctctcaccaacaaacaactacacgaggcagcaaactcaccctccgtttggcacgatctgtatctcaaaacgtttggagaaaacccattgaccacccacaagtggcccgaaatgtaccaggtgcgatcccgaagcgggctcttcacttggggccaaaacggccgaggaaagctcggtctcaacgaagcccatgtgcccagtgaccacaagacacttcgaggcatctgcagaccgactcaggtgagcggtctgggctccctcgtggtttcggacatctcggcgggaggttggggctttttgctacttgatatcgagggccatgtctacggcattggaagtatttccgaccgaggaagagctccttatgttcctggacgagtcaccaacaatcccaatacctaccccttcagaaaccctcgaggagctggtctattcggaggaagagggccgttcccttttcgagttggaggtctgattcgtcccgacattcctcctgtcaccaacaatgatgctcaacccactccccctcctcagcctggttctcgacctgctcctcctgcaaccacaggaatgtacggaggagataacagcgaccctcaaacagacgctcctcctcttgggcatggaattggacccgctgtgccacccagaaccactgctgagtcagatgccatcatgactgcttcgagagacgctgctcagaatgacaaaaaaaccaacgagggcccttccgaggaagatgtccgaaagcactggctactcaagttccccgacgacaagcaccccaaggtggtggctatctctgctggtcgatctcgagctctggctctggacgaagaaaataacatctggcagtgggacaagacgttctacgaccaggctgcccgccttgagttctcgttcggagacaagcgcattctcaagatcaccggaggctgggaaaaggccgctgctgttgttgaggatgtcggtctggttgtgtgggacggaatcagtctgaccaacgtggctgctgttcgacccgtggaacatgagactgttcccaacaccaaactcaccggtgatggggagattgtcgatgttgctgttggtcgagacgccattgtttaccttgacagaaagggagatgcgtacactatcgacatccacaagcttgccagtggacctgttcgtctggatgggttcatgaacaagctcaagctgtccgactggaaggtcgatgccaagttcaccaagcttaccggtaacttgacccatttcattttcatttctgaccgagacgatgtgtacttgactcctcccgatactactctcacagctggtacagagccttccatcatccctgagctccagaagaagggatgtatttctgtggctgctggagatcgccactttctggcactcatgaagggaggcaagattctgtcttggggatgtgagtctcagggctgtggagatcttggtctcggacaggctcaggagttgatcaagaacgatggagcctctgagcgaggcatggatcttgtgctttccaagcctacccagatccgtatggagggccatgctcttgccattgctgcaggaggctggcagagtgctgccatcatcaccaccgatgacattgagcacgatgagaagcagtagccgtggcaacagcagtatatagttgtgtatttaataaatctttttacattcactatctgtgctacaagtaaggtaattactgtagtagtagtgggtcttacaatatcaacccttcaggtgcttagtcatcagataacatctcagacatcaatcatcgatccttgctcaggaaacctccgccttctcgttctacgtgtccctgtcgtgtttcttctcggtctgaatcccccaatattgtttctgtgtcgttctgatgtcggtttgatgttgcaatttctccctcgtcgctacggttgcggtatctagtcaaatatcatgtgcaaatgtattaagtctactcggaggcaggcttctcatccttgataccctgggttagttttgcaattgtcgtgatccttgactgctcaatcagtcgaatttctcatcttccatctctccaatcatgttctccacatatcaatactactcacaagaatggttcggccagtgtaccagacggaaacgcccatggagacggcgaaacaagcgtagaaggggtacagcaggaacttggatcgggggtgtcgcttccacagagccacgttgggctgggactggaagagcttctggttcttgatgacgttgttctgggttagtaatgtggtgacacacgccgcgcaaaaaggccgcacaaaagccacagcccgctaaacgggacgtgctcagaacactggcggtggatctgtcgggtttcaacgcctcgtttcgcgtttatcggtactcacgaccattgtgatatgtagtgatggatttggtggtacgtctgagcttacttaaaatcgaatgtttgcaagcggccaatcaggctcggttcaaacccaaccttgcgcgtaaaatagggtcctgcgtataacacagactgcagtattgcctgatccaaggcgctttgagttcagctttgggagaagctgttggagatgagtggatggaatttgtggtgtcatattttttacataatcatgagattatgtaatcagaacagggacagacattcaaatgttcaaccctcgcaagggcgtaacattgcagaaaccaaagctattgttcacgtgatacccttagttcttcaaacgtacactcatacatacctacagtatacatgccacaagtacaagtacaagtatcggcagcgttccaaagcaagtccctgtgatctactgtacagtatcgtagtgctgggtgtgtttgggtatgtatggtcaatcaaggcctatagacttgctgggctgtacgatggccattaccacattgattgtgtttccgataacatttttattgataaatagttagtatgtattgctctccctgagtctgtgctctccctgaacctgtgctcgggtatctgtatctcactgaggctctcagaccgctatactgattgcccctctcgcacgctctgtctcttgccttcactttggctcccgcctcattagcttgagaaatacccctcgctatcactgcctcgggaaccgttaatatgtgcatccacaactctcgtgaatgtcttctcatctccgttggctaccccaatggttagtttggtaggctcgaccgtgatccacttgatcgcatgtcttacccccagactgatatctggagtctctaccggaggaacatgctcacttggaggcgagtttcttctcgggggtctctcaatcatcacacgctcaggaatatgtcgcctagagggacgtgcgtcgtggaactcctcggtaggagtccttggtgcatagtgcgaatctggagcatcgtggtattgttctgtgtgttctgtagtgtcactcaccgcacggatggaaacctccacgcgatggcgatagtaagactgcatgatgatgtggttgatggtggttccccagtcgagataatgtcgctgaccctgtctatcgagccagtgtatatttccaggcactccgtacatcatttctgagcctgaatctgacaactcatctgaatcaaagccgccttcatgggtctcaatatccagagctgaagccagagaggcgtcgaattgaaagtcgctgccatcttcgctatctgaaaagaggcctggaagcatcgagttgtgtatcgacagatctctcttgtattcttccgtttgtctttgcatgagttcgtcgtactctgctttcctggaggggtctgtttcgattatagctgcaataatggccttggatatacctgccgctgcatgtgagatatggggcttcttgtgacactccttccgacacgaaggacaggtgttgaccttggtgaaccaggtcgagatgcaatcatagcagtaagagtgcccacactccagcacacacggcagacacatgagttcctggcacacgatacatgtgactgaatcggcgacttgcgatagcagagacacacattgtgtttgagtctgtgttagttagatccgatatccagacgtagctgctagcggtgccggtgtactcacataggccctactcaacgctgtcacgtttaagttgtcggacatgtcagctctgtgacgttggcagtggttgaagggaaggagaacgagtccgtcgcttggatcgtctgtttctgttagtaaatagtgcttgggtgctctcacaacacttttttggcgtcacgttgcagataaagcaggcccgatgcaaggtggagaaatatttaaggttgtgtgcctgtcgcgtaattatagacactatagaggtgtcaaagtcagtacttacttaagtagacacaaaacgaaaagggacctgcaaaaacactctcgaccttgtattgtctcactcatagcacatcgtcacagaacgcccatctacttcgagcacaaaaacacctccaggatacctccaaacgaataccagcatcgcgatacctctccatcatgggccgaaagttcaaacacgccccccaagcccgtgccgatcgacctgctgattctccagcagcaaatacttcttttggaagtgacgctggcaaggctatccctggacattctgaggttcgagtggaccctgtgtctggagataaacgccgtcggcggccacagtggatgacgcgtctgcgcaacaacccagccaatgtcgtggaacaagataccagcgatagcgatggcagtttcagccactccaagcagattgacgacgatacccgcgatgacgacgacgacgaaattgagataatgacgcctcgcaacgtcagcagcgagataccccgttcttctgtcttccgacgagtcagcactgaggttgtgcctgcaccctcttctcccgacgactaccagcgcaaggtcagtggtgacaagcccagaaaggtcacctttgacagttcgcccactagtaccaaaaagacggtcgtggctgccaagagcattctcaaaaagcccgagccggagccctatgctgtcatgttgcccctgacacccacacgggtgctcaatcaggaacagccagtggcctccatttctactacggcagaaacccatcctagtcagtcgagcagaggttctagccggcctcaccgcctgcatttgcctcgaagacccagccggtccagcaccttggattcggtgatgggcaacgccccggtcgcagaagcgacccgggctgacaaaccacttctggtgacagttgactcgtcctcttcggagtcatcgccagaagcccccaccagctccctggccaaggagattgcgagggagctggtcaaggaagtcaagctgctccagcctgcgcctctgctgccttcacgccctcggggctcgccgcctgtgttgtcactcgacacgccggctgaatcaagccccagtcagagccatgctcatcgaaccggccgtcttagtgtccgccgtcgccagcaggcctggagacagcgtcgggtagttcgaaaggccattcggaccgacgcctacgtggacaagattgtcgacgagattaatgggcaggaaagcaagcccgagggtccgacttccgagccggtctcggagtcgacttcatcccctcgggttgacgggaaagcgccgtctttctactgggacccctctggggcctttgaattctacacttccgcgcagtggtgggaacatctgcgggatcgagccaactcggccaacgacgggtctcggtcttttcgaaagcagctatttctgaatgtggatggtgctgctatgtggctacatgcgaccgtgactgggtgtgtatctcgagttcggtctcgatgcgagtctgtgatggcgctagtttcccgaattcaggctcgattcgggtggtattcagatggcggagcagttccagcgtagaggacttcatatacgagtagaggtgcaggtacatactggtagctacatgggaagatatagggcggatatagataatgatgagtatatactcttgtggctgtgtggctcggcaattggtgggatccttttcaccccagcttcaatggcatctgtcatctgctgctttgggaaggtgcagaacatgctgggtactggagtgtgggaggtaaattgggtccccatagactaagtgtgagacagaggacacgacaagtacacacatcgaatggggactataggcattgatcctaatagcagcagtttcacactagtgtagtggaaaagtagtgtctcaggagtcacgagggcggcgctataacgtagttgtatgtatgggtgcattgagacgggcgtttagtgtgtctttctgtcacttgaaatttccggccctccaatctgggttctgtaagatcgagacaagctttgtgcaggagggtgttgagtgtcactatacgacctgtacgaaaagatacggggtggggacaggtctggagcacattggggcagtagtgtagtgtggggtgcggtggtacggtgggcggttgtggagacgttgagcacggactccaatatggcagtctgggaggctcaattgagtgggtcgtggcgttcacatactcgcgacgattggtctacggtgctccaacaagaccgccgatactgcagacggtgcattacttacccgtgtcgactgagagtctacttggtacttggccctgtggctaagcagtatttgagcaacaatgcaatgcagttgctgactcggttccagatccccttgccccgatgtgtggaagcgttgtttttggggcaagggcatgtgggggctgcatcatactgtggctggggccgttggaagagccgtcggcagcgagcctgagtcgcttctcggggccttattccccccgcctctaggtcagcggcggccgaagtgtcgtactcagctcgcctgtacagtatgacgtgaccgaatagcctctggaaggttggagaagtacagtgcaaaaaaaagttgcaaaatttcattttagcgttcgatccgacgtggcagttggacaatgaatcgatggagacatgatcatgggcagaaatagaaggtctccatgttcaatggcagtaccaattgagcaacagacgggtcgacaggcggcgggcacaccatccgccctccacatggcgcaatcgtcagtgcagcgattcgtactcggattgcatcatgttgcaccgaaagttggggcccgcacgttggagaggcgaggagccagggttagctttggtggggtcctttgttgtcacgtggcatcagcgaatggcgtcctccaatcagggccgtcagcgaagtcggcgtgtgatagtgcgtggggagcgaatagagtttctgggggggggcggcccaaaacgtgaaatccgagtacgcatgtagagtgtaaattgggtgtatagtgacattgtttgactctgaccctgagagtaatatataatgtgtacgtgtccccctccgttggtcttctttttttctcctttctcctaaccaacacccaaactaatcaatcatggtcctttcatctgtccttggtttcccccgaatcggtgccaaccgagagctcaagaagatcacggagtcctactggggccagaaggcctctgtcgacgagctgttcaaggtcggcaaggagctccgagagatcaactggaagaagcagaaggatgctggcgtcgacatcatcccctccaacgacttctctttctacgatcacattctcgaccactcccagctcttcaacgtgatccccgagcgatacgccaagtacaacctggctcccatcgacaccgtcttcgccatgggccgaggtctgcagcgagacaacgttgacgtccccgccctggagatggtcaagtggttcgactccaactaccactacgtccgacccaccttcaccaatgccaccgagttcaagctcaacggccagaagcccgtcgacgagtaccttgaggccaaggctctcggtatcgagacccgacccgttctcattggtcccgtttccttccttgccctcggtaaggccgacactgactctctcgacctcgagcccatcactctcctcgagaagctcctccccgtctacaccgagatcctccagaagctgcacgctgccggcgccaagaccgtccagatcgacgagcccgttcttgtccttgatctgaacgagaaggtccaggccgctttcaagactgcttacgattaccttgccaagcagaaggacattcccgagatcaccattgctacttacttcggtgatgttcgacccaacctcaaggccattgagggtctccccgttgctggattccactttgactttgtccgagtgcccgagcagctcgaggacgccatcaagcttgttggtgacgacaagactctgtctgtcggtgtcattaacggccgaaacatctggaagactgacttcgccaaggccatcaaggtcgttgagcaggccaaggagaagctcggtgaccgagttgtcgttgccacctcctcttctctcctccacacccccgttgaccttgccaacgagcacaagctggacccctccatcaaggactggtttgcctttgccacccagaagctcggtgaggttgtgaccgtcgccaaggctgtttccggcgctgacgtcaaggctgacctcgaggccaacgccgcctctatcaaggcccgagccgagtctcccatcaccttcaacaaggaggttcgagaccgacaggcccagatcaacgaggagtggaagaaccgaaagtccgccttcccccagcgactcgaggcccagaagaagcacctcaacctgcctctcttcccttccaccaccattggttctttccctcagaccaaggatatccgaatcaaccgaaacaagttcaccaagggcgagatcaccgccgaggagtacgagaagttcattgagaaggagatccaggatgttgtcaagttccaggacgaggttggactcgatgtgtacgtccacggtgagcccgagcgaaacgatatggtccagtactttggtgagcgacttaacggttacgttttcacccagaacggatgggtccagtcttacggctctcgatacgttcgaccccctatcattgtcggtgatatctctcgagcccgacccatgtccgtcaaggagtctcagtacgcccagagcatcactaagaagcctatgaagggtatgcttaccggtcccgtcacctgtctgagatggtctttcccccgagacgacatttccgacaaggaccagtccgagcagcttgctcttgccctccgagacgaggttcttgatctcgagaaggccggcgtttacgtaatccaggtcgacgagcctgctatccgagagggtttccctctccgagacggccctgcccgagacgactaccttaagtgggccgttgattctttccgaatctctactgccggcgtcgaggactctacccagatccactctcacttctgctactctgacttcaacccctccaccatcgtctctctcgatgctgatgttgtttccattgagttctccaagaagaacgagccccagtacctcaaggactttgcttcttaccccaaccagattggtcttggtctctttgatatccactctcctcgagttcctcctcaggaggagtttgagcagcgaatcgaggagattctcaagttcatccccaaggagaaggtctggatcaaccccgactgtggtatgaagacccgaaagtgggaggagaccaagaagcagctcaccaacatggtcaaggccattgagaagttccgaaactaagcggaatcctactgcgtttaaaaactgtatatttcagatgtcaaccatctgttttatttattagtgatgtcaaccgtcaccataacttattcaacatataatgtaaatacatcaactgattgtaacacacgcactatacaatgtacatactgtagccgttagatcttcatgcagcgcatatttcacagcactgcatatttcatagcattgcaactattattaatagctccccagctattaatgaaccccacaaaatgagggtgaaatgtcttgctggaagatggtggcaacaagacgcctgaggatcaaaaccattgctgccaatgtgttcaattgatgcaatttgttggtttaataagacacgacgtgatggagcgtcgtcttcacggaccgagcgtcgtcttcacggaccgaacgtcgtcttcacggaccatagtatggtgtgaccacgagaaagatcagtggaatccttgaatcaagtacgtactagtacagtgtacagtagttagaaagaccttgctcgggtctgaactcaccatgttttcagatcgtatggctcaagatcatggtctaacgccaccagttcggaggactcgaaggcccagaaaacttgtgaaagacgtccacttctggttcgaactctaccatgaagcaattaatgctgtggaggcgtttgtctatggcccgttggcaactataaagggtgtctaacggtggacacttcacgatctccaatcatgaatcgtacatgcgatactgccgccaaagagaggactaagtgagcgcacggtagaagcaattatacgagagaagagcgtagaagatgggcaatgtgtagaggcagccagatcagcttgggtgtcaatcttgccctgtttctgggggttatcagcgatcacaacaagaataatgtcgatcagcgatcgtcaggaaggcagatgtcaagtagggtgcaaggcaggggagggggtttgcacagatgttaattattgctgctgtgcaaaccattggggagagaattccataatggaggatattatttcatccccaatgtaggtgaagcaagttgctggagggtcgatttgagacacagggcgccctactgtaccttaacactatcatcccttgctagtcttatattgggtggttgagatggatagataattttatcagcgatcacgtcggacggggtcgattgcacgtgtctctgcgtggatatcagctgagcagggctgtttctgtgagttggcacgtctcctttaattcaccatacaccccacacacctattgtccagctcttttgacgggaggttgttctataagtagcaaggagtagcgaatatccaccacaggagccacacctgcagttacacgtcgcgtgaattaccaatgcggtgatgcggtgggtggtgtacagtcattagagacagcgatacagagcacagagtggtgagatatctttctttcgcagctctgtctgaataatactgcaataatttcccgagctacctcctgcactgcatagggctaaccctagtgattgacagttcctggaccgagagattgagagagagattttatgcaacgggagacgattgtaaagagggcgggggacgtgtagccctgctggacgagcttggccagctccggtaggctcccccgaacctccttcaagcacttctgtcctgtctcctgcaccccttacttgccagcctttttcgcgcctttttctttttttttgctccctctatctgcaaccttctgcacatgagagggctgggtggtgcagatgtcaacttaatcattgcgtgagccgtatggaatttgacaagtaattagtggagcttgtgggtcgaatggaaactggtggtagtgccagtgcgctggtatgaaatggcgtgtgcggtggcggctgatgtactgtagaattgtggcgtgtggagagagtgtgctgtatgattaccacactgcttcaaagggccctccccactcagcgtaacatgatcaccaccttgtcaaaatagcagccaaaaccgtcttgttagtccgagagtaatctaagagcatgttcggtgctgaagcgtctgtctaacagaaacgtcgaatcgaactttcccacacagcgtttcaggcgtgaaacccagctgagacactgggcccggagtcatcgtgtgtatctcaccgtccgcagataattatcccataattatcgcttttccaccgccgtacatggggaagaaaaagagaccatcaagaggtcatgtacatacccttttctgtaaatcgagagattgagctgtcatcttccaatgggctgtaatctgacgctactgtcgcttccgtctgtctaggcaatatctgacatgcaacgaaaccagtgcaacaacagatggctcccctctgcttctcctacacaggaacagacaaggtatcccccctggggcctgccaatctcctgcgaagccgaagacgccaagattattgcttttagacaacatcaaggttcgtccaactgatattgtgcccgttccaagcgtcgctggaagccccagactagcctaccagcagcaaactttggagctagtggttagcgtggcgcttcatgtagcggccctagtctggaaaccatggggctgtcaaggcgggtgcctctgcttatgggacgaccggagagtccgccgccagttgtttatccatcttgtcccaaacgggcagagactccaaaagtggcagccagggatagatcttcaagttgggcaaacaaagacagaggtcggaagaagcagttgaaagtaatttcccgagtgtgaagaaagaaaagaacaaacaagcagctactgcaaatgcaaccagctgctcgtaccggcattttgttgccactagctccccccactactggatcttgctgctcacgtaggcagatcgtgtgaggggcctggccacgtcagcgaccctcaagaaaaataccatgctctcagcccgacatattgacggacagactttcgccaaaacgacagagttcgtaaaaagcaacgagctggagcttgtgtgattgactttgtcgactcgcatcctcccacagagcgtgcgcgttctcagtttggagagagtgcatggctaaaagtcaagattggttttttttcttttttggtgatttttttttttccaatcaccccccacaacaaggtttcgcacccaccgcatcaaagtgctaagaggtgcagtacgaacgactccttgtttcacccttcattggcgtgttcttggtaattttctttttcgacacacctttcgagacccattcgagaccatctacaccactaccgcgcctacgaaccgcaccccgaccgcacccacgaccctaccctcggtccccacgccctacaccaagtgaatcggaaagtgagtatctcaggggtagacacgcgcggcgtgagagcacagtacagcaccgaacaacggaacaaacagctctggcgacaacggtcatgcaattctgacacggtcgcgaacaggtgaaaaatccggcggacgttctcgtagatattaatagccaccccagaactaacacagatggatctagagcatcccatcccgcccttgaacgtgaacaaacttgtttcgtctgagtcgtttgacttttcagagtcaccgtcagaccccgtccagaaaatgctcaagcggagatcgctgattcaagccgccaacaacgccgctctcaaacaccagcgcaagaaggaaaccgaccctggcctcgaaacgcctccgccatcgccaggtttggagcaagcttcccaaactcaacttgacaactccacctcttcttcccacaacacactcaacaacgacatggagagctctcctcgaacggcaggctccaactacacgtcgtccatcaacatcgagtcgccaccggactcgctgcaacagggcgcagacacacagtcgcccccgtcgtctcgacaaacatcggtggcctcgtacgactccaacgcgaccgacattgagtcgcgcaactcgctgaactcggtctttttcgactccaaggaggcacccgcagacccgcgcaagatcacaaagaaggaaatcaagcagcgcgaaaacatcagcgagctttcaactaccccaggctcgcccgacggcacagaaacaacctcagcgacaatcacagcatccgcagccaccgcctcggccgcagcaacgtccgaaatgaactccatgtacccatttctcagagccgtgcacgcgttcgacgcgcgctctctcgagacacacgacaaggactctgtctgtctctcctttaaacagacagactgcattttgctacatggcatggacgtgtccggatggggagacgccactctgctacacactggtgagcgaggctgggtacccacaaacttcttccagcccttccaggacccagaagcaaatgccctgctggtagccgtgcagaagtttgctaccaaccccaaatgtcaccctacaaagaacggccacaccttttcgcaaaactcggtcaactcggtcattgcaggcgtccgagcattacttcaggcctgcggtgccctcacacgtgactccccagccgtacgaagctccaactcgacgaaaaaattcagaaagatgctacttgccgaactagccgtgtttgtgggacaggcccgggagtctaagaactcgactgacgacgcacttatccaatcgctggttcaaagctgctacaacgtggtgtgtcgagctgtcgtgtttctcgacatctacaatctcaagcgagacaagtacggctcatctctaggcaactcgctggatgcaacggcgcgacactccgttgcatcctctcagagcatgcgttccgataccagcacgtccagccatggacgtgtttctggtcgaagctcacgctctgggcctccctcgtctcctagaaaggattcagccacaggcgaagactctcgtcagtctcttgttcttcacaagactgccccctttgccaatgctcgtctggacgaggtgtatgacgccctgatggcatacttaagtctgattctgcgtctgctcaatttgctcgacacgtctcaggatgacggccagaccatttcatcccagattctgtacatcgcccgaaagagtatcgttgcttctcgagctctgatttccgccactgaggacgtttccaatagaactccccgtactcgacgagctgaactagaagccaccaaggacaggctataccgattggccaccaagttgtgtgccaccactcgagagcttgtgattgatgagggcgctacccccgagtacgccaacgagcttgtgcgtgtggtcaacaagtgtgcaaagacagctggagagtgtgtttctcgctccaagtctgtcttggagtccactggtgacttccagctgagcagtgacagaccctaccccgacctcagaggtactaccgtgactatcaactcgttctacaacttacgacctgactctgctcgagtcggcgagtctactgcttccgaagccgaggaggaggctcctccttccactgctgacactgacgatacgacccagctaaccatgcattcgaacgcttccacagagagcactgcgactgtcgacaagccttattacaagctgacatcggctgctcgtcttcgtcgatccgtcgtgattgacgaggaaggagatgaaggcaactccacagtcggtaacgatgatgataacacggctgtaaacgaactgggacaagaacaggtgcaagatggagacaaagagaagcacgcctctttgctgcctcccttgcctcatgtgattccaatgagccagggtgaggctgttctcatcagcgaggaggtcggcgatgtcagtggaatcaccatggcttcggcggatgacgacactgtggatctgtcgacgtttgatcctgccagcaataatcttgccgctgtttctgtggaggaccagctcattgtcggtgaccagggacagattcagggaggttccatccaggctcttgtgaagcacatcacctcgaccgtcgaccctttctttgtgtccgttttcttcctgtctttccgacgcttctgcactcccattgagcttgctgagtttctggttgaacggtctcagaagcccgacgaggatgtcgtcatccgagtgttcaacaccttcaagcagtggctcgagtcgtactggaaggctggcgacgctgaggctcttccactgatgcgatctttcgcagagactctggccaaggagcacaacaactccgctactgtgctcaaaactttggtgaccaaggcccaggatcccaattacaagcctcccatccaaaagtgggttgctgtagcaaacaccggtcgtcctgcaatgtccatctataactctggagctgttccttccagcaacgtgagcaagtctcagctgacgatgatcaccagatttttcgacaacgttgccaacgctgcatctgatgctggcaatcgacgaactgcttctctgacctccaaccccaactgggctgcccttcgaaatgtgatttcgcccgaggccactatttcaatcgttggcttcgatgcctttgacattgcgcgacagttgactctcattgacaatgagctgttttgtaagatcaaaacggaggagtttatggacctcaacttcgccagcaagaagcgaaagctcggcaacgcgcagaacattggagctatgactctcaacaccaacaagctcagtgctctggtgggagactccattctgcgtcacgggctgaacgccaagcagcgaaagaacattctcaagcagtggatcaggattggcgacaagtgtctggagctgggcaacttcaactcactgctcaccattgtcagtgctcttcagtcggtgtccattatgcgacttcgaaagacgtgggagatgctgtctcctcggtaccagaccctctttgcgtctctcaaggccattgttctgcccgagaagaattttgtggcgtaccggtctcgaatccggcagcaagacattccttgtgtgccttaccttggtgtctatctgaccgacctgaccttcatcgaggagggtaacgccgacaagcgtctgtacattcctaaaggaggcgatggacatgcgccttccgtgtctgtcatcaactttgacaagcatgctcgaaccgcgaagatcattggcgagatccagcgattccagatcccctaccgtcttcagcccgtcaaggaactacagcagtggctccacatggagatggaccgtgctcagagtctgatcagtgaagacagtaacgggctgtggcgacgatcttgcattgtcgagcccaagtaagtttcattactgggtctttatttatttatacctctctctcatttgattgatgaatgaattatgtatgttatgaaccacttcttgtaaaatcacgatactgagtactttgtacagtacatacagtagttgcatagtttgtgtagtggggtgtaatgcggggttatttaggtgataaaagtccaccgctgatcaatacttgtacttgtacatacgataccgggacttgtgcaacttcataagcacgtcaattcttttttaaatcgacaatatgaactccggataccattacaactacccaggataccgctacagctctgttgtcaacccattgtcactttcctctccgactctgttgaacccgccagacgaccttttttacgacttcgaatcagatgggtactaccaggactccaagagatctgcctttcagttgttggaggatgctcgagaacagtacgagcacaaaaagatatcactaagcaagtacttcgataccactgtggcgttgctcaaaactctggatacctcagttccggtcttcagaaaagccggggctattattagatatctacccattgatatcctcgacaaggtacgggacaaccatgtcactgccctcctgctcgaaaagctcatccactacttctaccgtctagactggactaatttactgaaagcgttggaacaggacagagacacctggttgttcaatggttccggtgacaccaataaagaaaaagagaacgacaactactcgtacgctgaggcagccctgcaacagactcgtgattatgaaaagagaacacggccggaacaaaggactttcctacaagtgtgtgtctcgagcggcacacccacatccaagacgcgaacacgtcggtcggctggaacacaatctccgccatccactcctgaaaagcaaatccttcccatctgccctacattggctaacttgagatagatgaagtgtatatttagcttgcagaatactataatagagtgatagacagacaggttatggggtggggaatcacgggtcgtggtatataagagcgacctaataccgtcagggcgtcaatgagtcataataagttattggttgacattgttttttccattctgtttttttttttttttttttttttttttttaattctaatgattcattacagctatatacctagtaagccgggttattggcgttcaataaatcatacacttctgaatctttgcgatgtgcgctgcgaggcgctgtcggttggtttgtcgacgcttcgtctagttgatcacattgtcgtggtctcgaggtagtgaatcatggctaacagatcgagaaatcatatcaatcgtttcttgtcttatccagactcgaggttggtttagtttgttctgattacataatcagaaaacaacggctctggtacaaaaccactttgtgttcagcgtccgcctggctagctcaatcggtagagcgtgagactcttatacaagaaatctcaaggctgtgggttcaagccccacgtcgggctatttgcgcttttcaatttccgatatagtgtaggggctatcacatcacgctctcatcaagaagtcttcttgagaaccgtggagaccggggttcgattccccgtatcggagttgtggttacggccatatcctggtgaaaatacggcttcccgtccgatcagccatagtcaagcaccagagagcctagttagtattgtagtgggagaccatacgagaatcctgggtgctgtaatcttttttgatatttgtagttttttttgttttttggacacggtcatttttcactatattttgtctacgggcacttttgatagtcacatgacccgacttgcatatgcaattggtctgggggggacattgatagctccaagtgcaggtcaaagcgcgctatcccacactttgaacgacatgaccaacatccccaatccatgtttgttggcgattctggtcacgtgcgcgacctcgaccggaccgcagtttgtgtttcattacccgcccaagcccaagtcctacgggtatcgagctgcagcaccggtaatcttccgcgagaacgaggagtcttcaggtgatagtgagtcttcggaagacgaccttggcgacattctgtccgactccgacgagagcgacaaggaggaagaggaagctcctgctctggattatcggcgattgaacaaacgggatcagggcaagaaggagaaccgacgacgaagaaaggagatcctcaagaacctcatcagcaactacacaacggcggccgaattcgactacaactttggagatgatactccagatgatgatggaacgacaacagcttcgcagggcacctcacgaaagaactctctgtctgaaaactcatgggacaaggtgcttggattcgatgctcagtttctgggtgatattctgacgcccgaaaagagcatgtgtcaacagcggttcgagttgactctagacgatatggtgttcactggtcttcctgtgcatgtgaacgacgacggaaggtggagacggaaaaaggagtacgacagggaggagaaggaggttggagaggaggacgaggagccgaaatctaacctcgtgtcgttccacgtgtcgtttgtggtcaatccacctttggcagagtacaaccaacgcgtggacgagatgtacttttatattgcatcccaacttgcggtggctttgagagcagaacaagccaagtctgattgggtggggcaacagctacgtcagattgctcacctgagagaagcagcggcatacgaaaagcgtggaatggcggatttgtggagagaaacaatcactacctgccctctggctcatggcattgcacaactgtttcattctatccagaacgcctctattgcatccattgttctgaacaagagcgtgcggagtttccagattcccgtggagacagagatggcctctttaccgctggtaactgagccccacatctccggtgcctatcttaccaccgagtccttttcagattcggactcaaaacagctgcatttcgctcttctgctgttggatgaacctgagtctatcatctcagacctggaagcgcagaaggactacactctgtgtaattttatttcccacctaaaaccctggataccactcaaacaggtggttcaggacctgcagatttcagccgagcaggccctggggttcagcaagcatcttatttattggcgaagaggacgagcaattctgcccatcaacaagggaaactcgtacattgtgtctcccattgcacctatcgaatctttgtatgaatttgcacctcgatttgctgtcaagttcccaggcttgccgtctcttcccagaatgctgtcctctctctcgacgggaaagccccagcagttcgccaagctcattccttcccgcgatcacaaaaccatgtattaccgggcgctggcctggttgctgcagtatggatttgtcacccagttgcgcacttttctgtacctaaagatctccaagaagatcaagctgcaggtgaagaaccagacacgagataagcgagacaacgatttcaaccttactaaccctttagccatctctcgaaagtcgtctgagtcgctgaaggatagacacttttctgcaagtatcagcagtcatgtttccaaggactctcccgaggcatctgagatccattttgccgaagatgacagcatcgatgactccatcttgcttgagcccgacagagccactctcacccagcgaaagtggctcaacaagattcttgagaaccaacctcaggatgtggtcttgttgtttaaccgcctcaagccttactttaatggcaagcatgccattgagcaggttgtgattgaggaggggttgtctcgaaacgagcttagacgactgactcagtctctcgaagagcatcttttgatggtccgccattggtgatgggtgtatttatagctacaagtagtgtatataatggattccgttttgtatattaacacctacagtaatcaaatcaatcttctaataaataatcaagtcatctttggcttgtgggcaccaggcatcatgatgggaacgggaatgaaccacttgtaagtggattgaggagttgcaacaccagccattgcgttccagcagcccaggagaccggtggaaatgcagaaagaaccaccagcaacgagcagacggggatttccagtgaagttaccagcagctaggaagatgaccgcgaggtccagagacacaaacatgacgaaaaaggcaaccgtcgccttcagtgtacacagtgtcatcagtacacagaagacaaaccagcccatgaggaagactccaacagcttgggcaaactcatcttctgtggcgtagtacttttcgattccaataggtaagttgagcatggcccaagagaaccagaagcaggagaaacagaggaagacacaggccgcaaaggtgttttcggcgacaatttcccagataccggcaatgagttcacagagacctccaccgaagatggcgcatccaaccatgacattaggagctccaatacctcggactccacaggtgcagaagccaagaatgatcattgtcacggagaaggcaaacagaccgatgggagcagcatttccaaattttctagagggagcaggggcggatccagggttcagagtacctccaaacgcctgcatgaactcgttcctgtggtatcgagtaccggcgatgatgagatactctccgttttcaaggacacggccatccttgccattctcgacatgagagattctgtcagtagaaccaccccgttcgagatcaaggtcgctggccattgcatgagaagagttgttgagggtagtcattttgtgatgtccaacaaaccatggctgatcccttttatatatcgcggaaggtatcagttgtttgggtggagtttccagcctcgtaagggtgttgtggggtaatgacttagcgaggtgctagcagcaggccaaagtagtggaacttttaactgctggaaggtaagaggacagatctacacctgttgggttggaccacctatacgtggtgatgtatacgggagggtgatgacaaccttgcatgacgtaaagccggtgcaaagaataaaaagcgaacctggagttgatgaacctctaaaagcctgctcaataatttccatgaagatatcaaacccagcataccgcggatatgtgcagagtgtaccattaggccgatctagaccctaggctgcagagactccattcgagttgcagcctctgtgcggggctaaaaggagaaagcacacgcgaggggggtttctcgcctctgtagaagtaacttgaaatgaattaatcaacttcttgggggaattcagggggtgctgagcactttcggtgagacctcggagcacagtgcattagtgaaatgcctccatgctacacttgaacaaatgttctacttaagcagcacactttttacccctcattcgaggagtttactattagaaacgtgtaacaggtcaaaatctcggttcttcatgccctgtttgcgcttcacgcgacaagttttgacggtgttttgctctacattgcagctaactgtttttagcgtgggtccagtgggggtacttgagcgggacgtagcgagtccttaggtaacttggaagacgaagaattgcctaagggtgctcaactacatgtaattgcggggaaccattctccatgaatgaagctagacacttgtttttgcgtagccatggggtatcgtacatctggaactgccttgcaacgctagtttagttctctcgctggaatatcgaatgatccttgcttggtgttacagattgatgaattcacatggagcagtctttagtatgttaatttttctggctttcggagcttcagagccctacgtgtacttgtacaagtattgacattccttaccggtaactacatgtatgtgctggtacaagtacttgggcaatcttccatcgagagtgccaatcagaaatctagaccttctgacaagccgcatattagaaacgccaacgcaacacgggctctcttctgtcaattaaaataattcacacacaggctaaatataatgtacatgttcggggttgaggccagtcagatgcttagagcttagccttgtcaaggaacttctgggcgacaaatcttcgctgaatcttaccagtggcagtcttgggcataatgtcggtgaagaaaactcgagcaggaatcttgaactttgcgaccttatcagccatgaagtccttgatatcttgctcagtggccttggcgtccttcttgagaacgatagcggcattcacctgctgtccgtacatctcatcgggtgcaccgaaacacacagcctcggccacggcagggtgctccagcatgactccgtcaagctcaatgggtgagatcttctctcctcctcggttgatgagctccttgattcggccggtgatgttgacaaagccgtccttgtccaggaagccctgatctccggttcggaagaaaccgctcttggtgaacgacgacttattggcctcggggttgttgatgtaacccttggtgacgttttctcctcggatacagatctcggcaatctttccctgagggacttcgtctccgttgtcgtccagaatggcgacttcgacaccctggccaactccgacggttccaggctttcgctgtccgggaggaagattgttagaagtcatctgatgggcagcctcagtcatggcgtaagcctccaggacgggggccttgaatgccttttcaatctggtggaaggtggcgggtgccagggccgaagagcacgatcgaatgaaccggatctcgggcagaggctggggaatctttgtgttcagcagaatctggtggatggtgggcacggcagtgtaccagttgcacttgtacttgacaaagtcgtcccagaactgcgaggcagagaacttgctagggattacgattcctccaccagaggccagaggggccaggaaggcacacagaagaccgtggacgtggaacagaggcatgaccagataagtggtgtccttactggtgagcttgtatgtgtcgacaatgttgtgcatggttcggcacaggtttcgctgggtcaggggaacggccttaggtcggccggtggttccactggtgtgcagcacgagagccacgtcttcgggggagacctcgtcgggggtggggacggcaacgggagggtttgtagggccctccttgatgtccatgacaattcgcttcttctggtcgtcccagtagacctcagcgatggcagcattaaaagttcgggcagcctgaacggaggccaggttctgggccacggctcccttgggtaccagcaccagcttggacttgagatcgtcgatgtagaactcaaactcggactttttgtacgccgagttgagaggagcagcaatgtatcgagagaaggtgactgccaggaaggtcacggcaaactcgagagagttggggatggcaatggaaacagcactctggggaggaagaccgacctgggcaagctgtttctggaagtcgccaatgagatcgaagaactggctgtaggtcagctcctgggcgccggggatgaagatcccggctccggtcttggaaatcgttttctgaagagtcgccatggtgtggatacttgtcgtgtcgtgagatgaaggagtactcagcggcgttatatataggtgagtaataaatgcactccgattccggggtaacctaaatacgatgcatctcaacggagtccggccaggaaggaaaagagggagagcaagagtattcagcacaagcagtgcgatatcatatgacgcactggatgtgtagaatagaacagggcaattcggccgacggtgcatgaacccattgctggatagtctcttgtacgagtacttgtaccagtattgtctaccgaggttctccaaggttagttggtaacggtgaacgccacaggcgccacaattacaagttgacttatgttcagcctccgttcagcctctggtcagcctctagtcagcctctcaccatcctcagcaacccgtgaaatatgccattcgctctcttctgaccacatataccttttctccgctacacaagtagcaaagtcccgagctgtgggggtgggaaagcaaccatcccccacttttcaaacgtgggggtcaccggaactaaaccgacctgcacaaatcgaccatgtcaactaaccagtctcgttacagaatgtggtaataaagatgcagtggtcaatggcgtgatcgaggtatctattagtcctaacaacttcgcaaagtatcactaatcatcttcaatggcacgttgcagttccctttcaaaccagataacagatggagttcctacttgcggcaatctggtgtcttgtcttcatacaccatgatacacacaagccacacgcaccgtctgaaaacaggtgcacacacacacatagcttcacgtctgaaccttaacaggatggaaaatgcacaaggaaaatataaaaaatcaaagggtggtaaatgtgtgacagaagaaacctgtgcgacgactcccatgatctccggtccaaaccgctgtagttgcgtaggagcggtcctcataccgaaattaagttgatgaacactctattaccctcctcacgcgagatccaacctcaacgcacatgatacctctacagtaatcaagctcgctgaaacagtctacagtctacgtccgtctgcatggctcaagacgacattgaactgggcctcattaaggacaagcccgccgaatgggctccggaaacaggttcgtcggaaaaacacatccaccgcccgccatggaacctcaagttgttcgtgctggttgtcctccagctgaccaccacggcagtcgtgattctgcactttagcgagctggagactcagagtccgctcggactggccgcgctcatctgtgtgtgtctctcgggcctcagccagggcatcacccaggcgtttatcacgcgtcgacccaactactcacagctcttcaagttctacgtgtggggagtcatcaacggcgtcaccacaaagatgtggaccgacatgctcatcgccaaggtgccagtcaccattctcagagtcgtcatcgaccagctgtgcggaaacccgggcttccagctcatgtttttgtcgctatcagcttactgggatgccacgtccatctctgcaactttgcatgaatccttctggaagacactcaaaagcagctggctcatctggcctatcttctcaatggtagccttctttgtgcttccccaaaacctcattgttccttgcaactgtgtcgtgaacctgacatggtgcgtcattctgggactcatcactcaataatgctaatagatagaatgtgtttgtgtttaccaccgtcgtgatttacggctgtaaaaagtgaaaaacaaagagatatacagctaggggaaaacaattacacgccacgcccctacaaaaagaatgctccaggaggggattgaacccacgaccgtcgcgttcctcacacgaccgtgactttgacatagagaatgatcaagtctaaaatctataagcacgaagcgctaaccagctgcgccactggagcatcgaactcacgacctcgaaaatacaaacccaaaccttaattcgcgcttgcaccatctaggccagaaattctgatcttgcgttttcgccgtttttggggcacttgagccattgcttcaaaagtcacgtgacaaaaccctttggatttcccttttcaatgatttcggccggatggcgacgtggggaaaaaaccaatcctatagagaatcaaagtgaaaatttgaattttcaatcttccaacgcatcaaacccactttgacatctcaatggctcgtaattgtctggttcaggtttgtcaccttggggtcgttatcgaacgctaattggggatgaggaaaagtgagactagtgcgattttgagccacaaggtgggcagatttgctttttgtaagcttacgggaaggaaacaagcacatttcccatttgttttttgctattttcagtgccgctaaagctgtgagatactcctactttgcatattatttgcaacccgtcgacatgtggaggtgcaggtggcttttgcgataacgaaacaaggtttatgggaagagcgataaatttcatctcgcttcacagctacagtacttacagcacaggtgagacttaacggcgtgtgtgtgtgacccgacgacgaggcaataaacccaatggaagaaaaggcccttgagccttgaaatggtgtcagtgtgaagacaaagtacaactcaacacaatagtattttgccttagatgattttccacgtggggaaaaagaacttcacttaaagataaataagccaacagcctcctgacaccgcctgcgctgctgtaccggtactgtaatttttttggttaatatatctcgcttatttacaaaaactctctttgtgcttgatatattatactcgcttatgcttgcttccaaagtggcttattatcgctcacacaacgtactgtaaatgagtgggcgggcttggcttgctaaacatgtaccagtagagagacatacaagggccgtgagccgcacagccgtcagggatggtgaccatagttgtccaaaaaagccgcatgcaatattagcgcgggtttttaagcgttgttggttgtctgtttttctttggggggtcccaccataatgacaatccgacaatgcgtaataagctcactcagttgcagtagttacaactgtgggaacctagaagcctaatgtatagagtcgtagacaaagaattgcatctagagccgcacgctcttttccacagcgggcccgaaggattcctcctgttgcaaacgcatcgcatatcggagacaaaatgagcagtcgcgacgtgatcagggccctggcacccctcattccgcccgaggagtgtgctctggagatggtagcggtggcccgtcgtaaacaccgacagggctggatcaagctgtttgtcagctccgtatgtggaggaatcatgcaatccattggagccttcgtcagtatcacggtacaaggaaactcgatttcgggccagcatgtgggtggggcaaacgactggctgccaaaggtcccagaggctggcgcctactccatcggactgattctcatcaccatgtttggtctggacctgttcaactccaacattctttttttcaccgtgggctgcgcgacccgcaagctgtcaccgtgggctcttctaaagtcgtgggtggtgtcgtggtttggaaacctgggaggagctctgtttgtcagctacattttcgcctactccaccggcctggcacgatcggaaggaatggtgaacgcatcctacgtgtctgtcaacaacaagctgacaaacccaacttgggctcaactgtttgcacgggcagtggcctgtaatgcactggtgtgcatgggtatctatctgtcgttcatgtgtcgaacatttgtggcaaagtacattgccattctcatcccggtgtttgccttcgtatacattgggttcgaccatgtggtggcagacatgtttctcatcagtttgggcctgttcaatggctcaccgcatagtgtcgggcttttcattcacaagtcgttagtgggagtctctgtcggaaacattgttggaggcagcgtcttcgcgctcgtggtgccgtggtatctgcactacttcaccgtttcggctctgcacatcaaggattccattgctggtgtcaatgccgacggagtccagatcggtaccgaagtgggagaagaagaaccaaaggaagagccgtcttcgtcttcggccggagagtcgttcaatcctccgcaggcccccgcttcggcgcgtattgcaccccatgcacagtcgccagtctgatgcatttgatagaatatttatacaagttttgatatagaagtaatcgcatgagttgaagacggccgatagactgtatgctgtggtatgaggatcggaatcaacataaaatcacagacgaagggagtgattttcgaattgtgatcctcccggaacaagggatcactcgtgcggccacatgtatcatatgcagaagggtactgtcggtatggggtattgttgggggtaatcgcgcaatggcattttcatttaaggaagttggctgttccagagagtgtcaggataaactgttttccaaaggtatcgacatgtgtctgatccgtcgacgtagatttgcccaaaagtcaagcatctctaagatatcgggttaatgtgggctagaatggaatgaaaagagtcccaagtttgtcaggcgaagaccgtgtcacaatgaggagtgagaaagggtacagcacacatggtactgtagggagagtgtggggtaaagtgagccatgaggatggcaggtggcaggtctaatgaatgttcgttgctgtaggcaaaggaagagaaaaggggagattctgaagtaaaagctctcatacacttgcataatagaattaatatctcatttccaataaataccagatatgtgctttcataattctccttacgtcaagtctatgtttatgataacagcggtattgtttggagcctggactagggtaatgcagtatgggtgtggattgtcgcaggcacaagcagttggattccgcaacagagaaatttggaaggatcatgggacgagtgaacaaaataaaggagaagaggtttggaaaccattcactgatcagtatcaatcacgactatcccgagctttatttacgcttcaactgtttacttaagactcgagagactttaactatcatttggagtgccaaattcctccttcaacgtccacgatactgctgtacttccgttgcgcgttccatattgagagatacagagacagatgctggtgattaccgcaaacaaccggaaaaaaaccccgaaaacaacaacaaaaaaacaacaacaaaaaaaacaattaaatatctacgataacagctcatctaaagctctgggcttctgtttcagcctcaatgcagcatgcacccattggagcctgagtcaataaaccaggtaaatatatgagtgaaatagattgatcgcgaaaaacgcttgattggatcatcgatcaacccatcattttctgcttctttccactacaagtacaatcgccccttccaacaccagcttacatcatctgccggggtccatccccagacaaattagatacataaagtttcgcgtcggacgcgatctccagaagacacaccacacacaccaagcgacacgacatcatattcaatgacggccaaggcgcgattgaagacgacgaatctcctaaagggagacacgggcgccatcaagaacaacgtcaaggtgagtatctatccttttctatcttctacgacattccaattgtgtggtttgctaacctagaaactgctggacgagctgagaagtgtcgaacagggaggcctggacatcaatgcctgcaaacctatccggcaggcgcttctggacaagcgcattctcgaatccaaagatcagacgacccaggcgtacgcctcgctgtgtttcctggaactcctgaaaatctttgctccggatgcccctctttccatctccgacctggagcgcgtgtttcagctgttcaagcgccggttcaaggcactggccaacaccgaggccgctagctacgccgaaagctttgaactgcttgaaaacgtcgagtctctgaactgcattgttctggcgaacgactttgaaaccagagataagttcattgacgatctgtttttgctcttctacaagctgtacaccacaaagcccgacagcaaacacgccgtactacttccccgtgtacttaatcagcttctttacgaaatcaaccaggagggcaatttgcccatgcagtctgctcgagtggtcttctctcagtttgtggctgtccccaagaagaagactgcgtccaagcaggcctctctgggctttgagaatgctggatacgcgctgagcaagattctgtgcgccgataacaagacggtcatggccaaatctttgtttgcgtatttcaacgacgtgttcaacagcgagtgtggagacgacgcagaggaggacgaagagaccaaaatgacggagctcactcgattacacaaattggtggtggagatctggaaggccgttcccgaaaccattgcccagctggtcggatatttgcaagctgaactcatcaccgaaaagacagccgtgagattgctgctggtagaggttgtgggagacatgattgcgcaccagccttcagagatcaactttgtgaccacctacgatacctgctggaatctgtggcgagatcgatgtcgcgataaggatcccgaagtgcgtgaaatgtgggctttcaaggcccatgatattctcaagtatcgaactgacgtgactcgagaggtttccaagatccttctgcagctgttgattgacgaagatgagagagttcgaatccaggccatcaagtctctgggtgaactggagccggagacgctcaagaacctcgtgggaggctcagacgaattcatcaagctcatgactgaccgtatgggcgacaggaagcctcttgtgagaaaaacagccacagaagtgtgtgctcaactatatgctgatgcataccccctgattgagcaagatgaggatgtgtccagtattgccaattggatccccagtgctcttctgaacttggtgttcaagaacaaccccgaaatcaccttcaacatggaacgggttttccatgaggatatcttgacacgagaaactggtgttcagactcgtgtggagcgtcttttgtcggtgttgggatctcttggtgatgatacttctcctgccagaaagtcgttccattcacttatcaactggcaaaacaccatttctgagtacttcaaggcggctgtgggggatgtcatcaccgatgctcaaaaagagtctattatcgagtggatggccaatatcacacctaaccccaagcttgcaagttctgccatcgctgagcttctggaaaactatagtgaagacctcaagacatgtatttcacccgactcgactgtgcgagaggtgattgaggcacaggatcgaattcttgacgagttctctggagaagccgcggaagttattgctgtgcttctctatcgaagctccaacttgctcctcaacaagcagattctcgcatctctggtcacccagcccgtggctgcttctttcttggagcacgtgtctagaatcaacccagcccttctcacagcccatgtcaacggcatgttcgagtccattgttgccgagaatgcctctgaagaaactcttcgaaccctggcagctatggccaagcggggcaacaatactctcaaggttcctaagatggcattcaagcctctgacaaagttaattcttgacggtgagcctctagaggccaactatgctaccgccattgcctgctgtgctgccccttcacttctttcagcttcggctatcaaggctctggttggttctgctaacactgattccaagtacactgcgttgacgcaaatctacaagcgaaagcctgagcttctagagaaacatgacctaacagaacacgtttctgacttgctagcaaatatggaggaccccgacactgaggtgtctggcttcgcggtatcgtttgcaatcacccacgagactgctaagggtgcccctaaccttgttgacaccatctgcaacctcattgaccccaaggatctagaaatcgacgaagatggggagatggttgacaacgagctatctccttctgttcatctgtgtctttctctggagcttctacggcttgcttggaacccggcatacagagctgacaagattcatgcccagcacatcatttctctgtctcgaacagttcgacatcctgatcccgaagttcgaaaacggttcatgcagaaactcatgtctctgatgaacaagaacaagctaggctggaagttccttcttttgccgctgctgtgcatcggagtggagtctgaagctgcttttaaggatgatgttgtccgatgggtgcgtgccaagcacgacaatgagctcaaacaaaatcccaagtccaccgtttttgtggctctgttcccacgtcttttgcactttcttggacgtgatctcatcattcacactggaggagccgtcactggcgatcatctagaggagccgttgtatgccattctggtctttctacagattgtggcagatacagacaatttggccatgctgtttcatcttgctcagcgggtcaagcaattccaagatgctgtagacgaggagcgagccaacattatgcatctggacaagggcgtccattttctgtctgagctggcacagctgtccattcgtcagtatgctgagaacaagcacaacatgcagatacccacctatcctggcaaagcaaatatgcctggcgatatcttcaagccgttcgatacccccgaactggctaaaaaggcgtctcagacgacgtacatgcctcaggaggtggccgaggagattccccacagtatccgagtgttcttgacgtctcgaaaacgtgctcaggaggctaatgcagagaaagccaagaagcccaagaaggccaagaccatcaaagcacccaagaagacgaaaaaggctgccagtaaaccaaaggccaagaagaaagccgctgggactgaagacggaccacgaaggcgaagcagtcgacattctggacgagtgagtgactacagagagaagtctgttgaggagttggaagaagaagatgaaagtgaggacgaagagggcgacgaagaagaggagagtgaagaggaggaggaggaggaggaggagggagaggaggaagaagaggaagaagaagacgatgaataactgtatgtattgtattttaatgttatatcagaattagccgagatcaaggtacaagtacctatagaatgagacgatatcgttatgaactacatccaaaaggtacagaagaacgtcgttgtccactcaactctacaaacagatataaattaatgtctattgtacaaaatacctaactttggtagtcatatcagttacagcatagtcgtcagaagaggtcggtaggggatcagaaaagagttccggcggagatcagtcacgagtctcacttttcacattatcattttgctcctccttgatcttcttctccaccagatcggctatcttcaactccgccaacacggcatccaagcccttgctggtgacaatctttctcacttcagccagcagatgtttttcggataacgagaacaagtcctgttcctcgtcctgctccacacccgcctccagatcgtcgggacctccgtcactaatctcaccatcatcgtcatcgtcttcttcctccatcttcacctccatctccttgtacttctcggccatgtccaacatggcgtatgctgccacggcttcatctctagcctcgttccaattatgcatttttactgtgtcgatgaagtccaatttgatccctgcttctggcagtcgataagccactccatcaatcaccatttccctcattttggcccgacgaatatcagctagcgacggctttatagagaggggtaccccctcatctccctcatcaaggagaacctctatgttaccatcgttaacaaaccctcgctggaggtccgtatcaatacgtttcagtttcttgggctttcgaggcagattaatcacattatccacgtgattaggacacttccactttcggcctagcatcttgacattagccaacggaggatcaatgcagtccagatgccatgctgtggggcagtaatcacaggatgtgattcctcggccattgagaccgttcttgccgcacttgaagcattcgagcggcttgccgttcttatccaggttgcgaacgatgccgacctctcgatcatccagagccagcgtgatatccttctcggtcttttcgtggtcgtcggaatactcgccaaacggccctgtgctgacaccctcaaagtattcgcggatgcttttgggaagacggaactccttggggttggtgcgactgatgcggtttagtaattgcgaaaaaatgcccctgggagcctgctccggagggaaccggcgggccttgcattccttgcaaaaccactggccgtcgggaagcgactcgtcatcgtaaggcgggtcggaacatgcaaaatggaaagatttcggacatgcctcgcagcagaggaaccggcctaggcccttgcacgcgtcgcagaaatcgtcattgtcctggggttagatattaggttacgggggatacttgtggacggttgtgaaatagactcaatgacacggtatccagggaaaaaagatgtggtggtgcaacacacgagacatatccccgctctatataataatagagtgaggttcgtgtcagctcgtcagatggttatgtgtgctaaccttgctggactcaacaaagtcaagccaacataacttccaagaacacaccaccaccaaaaaaaccaacaatgtgtcttgacagaaacgtgtcagaggacaggtacattgacagcaatcatgcaacagaaatattcgcatgatcacttccagcatgtttcaatatagttaccaatccaacaatactcaccttggtcgggtcgtcttcactagggggagccgcgactcttggcggcgttttagtcgcaaatccaaacggacttccgggctttttgggactgagttagcggagaaaaaggaagtcgaacagcgagagctgttcggtagacagcaagagggggggcgaggcaaacgggcggccaaaaaatctgggcgtgtggggtatgggtatcacagggtatccaccacaacaatctgtttatgtgtcaaaccgcaatagatgaaagcaaacgcaatttgcgagcataacatcgcagcatgtaagcaatgacgacacgaccatgacaacgacatgtcattaccaacaacatactttgattgtagtaaccgcgtcagcattgtaacattgaagatcatgtaagccgtcactttccacctctctttctttctctctctctctcgctctgtgtcttaacaacactctctcatgggtatcaatatgtaacacgatggcgaacaattcgcgtaattggagttgcactcatgtactcacctggccaccttgatcttaatatgcagacccgaaccgtgtcccaggttcggagtggatcccagctttggagtactcggggtcggagtactgctcttatccttctttgctgatcccttgggtcttcctcgtttcctcggcgtactggaaccgcttggcgtcgcagtcttttgtcgtttgagcgagcctcgttctgtggacggctctgtcttgtccagagccaccttgagtgatctcttgttggtggactcatactgctgcacccggtcttccacctgcggtgacgatgatggcgacgacggacgcgtgctgtctgtggtattgccgttgggctcgtgtccattaacaccgttcgtggactcgggcgccggactggactctgacgaagccaccgacgaggcgcgactcatgcgcttgacggttttcttgcgtcctcgtcccgactttttcggcggtggagcgccaaagttgtacccggtcacggagttctgcgggcctgccgtctgtggctcggtccactcgggcatctttagtggtggtgacgtgcctgaagttattgtgcgatgggtcgacactctctggtgtaaagtgaaaagtgcgtacgaagtttagtggtgggtgtgcgacagagaagctggatctggtaggagcacagttgccaaaaaaagcagcgtgttttttggggacgaaatctcgtaattacctggaggctgacacaagtatctgcgccagttaattgctagattttaataatggatatcccgggtctcgagtcctgtgtctctgttgagagttgtgtgggtgtgagatatacaactgcacgctcctgtttttctctggtgtgcactgctgcagttgtgtgtgtggttaaacaagtgctcgtgtgtgtgtgtgggcacggtgagtgggtggtgtacgcggttgagtgttgtgcagtgattcaaacgactaatatactgtaattccgagagcctcagaaaagcagtctgtcaatcaacaaacgacaaaaatacccacctcaagaaagcaataaaccaagctcggtgagggtttcggaagtgcggatgcgcgggatcttgttgcaggttgcagcggtggttgaatgtacagttattactgtttccgtcgatgtggcgggggcttgtacaagtggctagtacggatggcgtgcgcaccgtgagcattatatgctgctctcttttgtatttcattatggtaatccctgctttcttttatccaactaaagtcggctggtatttcactcgattacctctgcgagcttcagggcctgcgattccttctttggtctctttccatctcgtgatgcagccatagatgcttcttgtaaggacgctgttcatggttcatgacacatgttgtgctcccgtctcgtactctcgacaccgtcccatgactaccccagtagcttaccgtctttctctacattatcgcccagagctgctccaggagggctggttgctgcatacatacaacgtgctcacgggagaggtacgagcatgcaacccctctgtttcaccttactccggtggacacgatttccgagtggtgaaggagactgtatgtcgacaccttccgatctctactgttgccctacagtatgtacttgtacatccatcgtactcctcttgcagaacatttattaagctagtcgagcgctacagctcgcggcagctagagccaacttggtcatgacagtgacaccgcccacagtaaacgtgagcacagcagagacctagctcaaagaccaggcccaccaccatcgcgacttcaagagcacttgctctcaactccgaggccgctaagaggctcgaaacgtggcctttaagtttgatcagcaagccagggcacttgtcggaggtcttcgtcaggcacccaagattcgacagggcacagctacttgtagcgagtacgaggctatacaagcgcgatttgtaagcaggcggccgtcgttcggactcacctgttggaacgaagagtgtctttacttatcgtagtactttcgccaacaccctacttctcatgagaacagaacagaacagaacagatcccatagaaagaccaaggtgtactcacctgaattgagaagtcagcaatagaactattgtaccaaggaagtggtcgtttcaattcatttgatcatgtctggggtagtcaaagctccgtctctcgcatttctatggatccgctttagggatggccctgtctagtataggaacaggacacgtgaagatacgacatgagcttttgcttgattcaaagaatggatttggaaagtggtcactaagctgatacttgtcttcaactatttcatgtcattcgagactcattccaccctgtgactccaacaacttttctctattcatttccatcttctccttaaaccagtaaccacttcagtgtccccattcaacatcacgaaagccaacgcaagttgacaaaacaaaactgttgaaggatccttttaaaagacctgaagtactcgtacttcaacttgtgcactttcttcctttgcagtttgagaacacaagtgcatagcaaaagtgctttgacacactaagtaatacctacttcacgccttacaaaatgaattcaagctgttatatatttccgagcacttcagaagagaccccttcttacatgtgccatgaagactgtctttcaaaataccgaatttacaacttcacaccggctgattgacctgctcactaccctatattatgtacatctcacgaacaagctgttaacactttcaatataacaagagcatcataatgaccacaacgaattgcactatcctctttccattacaccttcctacactccattacaagtactcgtaccatcggatattaccatgtcatcatcgcaatcatattttcatactaaccggtatacatcctattctgcctatttaacgtgatttaagcagaagcagcctcctgggcctttcgctccttcttggagagcttgaggggctcagcgagaaccttgaggagatcctcgttctcaatcttcttgtcagacttgacgatggagaagtcgggctgaggggcggtggccagcttgatgttaccgtccttggtgacaccgacggtggtgaagaactcggcaacaatctcgccgtccttctcgtagtggacgtcgtaggggatgacgagaccgtggttcttgcactcctggagacccattcggcccttggtggggtcctcaaggactcggacggagaaggggaaggctccggccttcttctggacctcagagaaaacggctcgagaagatcgcatcttgagctggtaggtcagatcggtcttcttgtagatggtggttcgggtctcgccctgcttgaccttaccgtcgccggtggagacaagaatgtcgagtccgtagacctcatcagcctcaaaggtgaaggtctcgaagttctgcttctggccctcggtggggttgagaatgatctgcttcttaccatccagaatgttctggccctgctggtgggtcagcataccctcggcgggggtgcagccgtaggccttgcagacctcctcgacgtttcgggtcacgtcccagttcttgttgccgggcttgatggttcggacagcgacctcggtagcgtaccaggcggcagagatgacatcggcaaccttgccggtgatggggccctcggcaatggggccgccagagacaacgagagtgtcggcaacaacaccgccgtagccgtcaatctgggcgccgagagacaccttgatgacgtcgccggtcttgaggttgatcttggcctcgggatcagtggagatgggagacagatgggcaacacagttgttgggggagatggcggtggggaaagcaacacccttggtcaccttcttgcccttgaagatcttgttggtctcagcgacgaggagctcgtcacccttgacacagatgtcgtagaggttggcgccgtcgacacagagggccttgacctgctcaagaaccttggcggagatctcgccggcggttcggtacttgtagacaacctcggagttggcgagggtggtgttaactgtgttagttgggggttcaacggtcgcgcagccgctcaattcactcaccgtcagtcttgggggccattttgtagtgtggtgtagatgctgtgtagcggtgtgcaataaagattttttcaactgcgagcggtcacgtgctaacctagtgccaagggtggagcggagtctggtgcgaagcaaaaggtggagtacgagcgcgagtgcttggggagctgtgccgttaacactttggagccgggaatggggtctggtttttggagatggtggcttgttggagttgctatcaccactttggacatggtgtagcatggtcttgtcatgatattatgataacgttgtgtttgagagcacggagtggggtccaagcacgggcagaaatgggtgacaatgaatttagacaaatgggaatatatattaacaaatagaagatggggaatatccgttggtaattgtttttttatagaattactagggcggcccgtgtcatttctcacacctttcaattctcgattcctcgatctgaacaaagttggctgctcgtgtgacctgattatggtaccgtaatgaagatgtgcgtgttgagttggatgttagttgagccgacaggtaggttccatggctttatatttcgagctaaagtgcctttaacggtgacacgagggttggattcgcttttttgtcctacttttcatcagataccccctctttcggcagcctctcaaatcggccacacagtttgcacgccgtaagtatagcctacagtattggtggtgtactttaactaagttcaactaaactggataaaaaaatacagtagtcccacacccttggaagtgctacgcggctaacaatgcctactcggaaaataagcttcgacttatctcatctcagaccgtcaagagaggtgttcaaaaaccgcttcgcagtaatcagtttgctcgtaaatggataaaatcaatcaatatgccacttatacttcagagatattctttcccaaccttggcggcaaccacagccactgctacagccttctcaagcggtccgcttccctcttcgatgtcaaactataaacaccatattgactcacttctagcgagttgcgaaataccgctctagcaagtgcaattttcattttttgtcaaaaaccaacaatgaaataaattccaaatgctcctttaacccccctgaaccactctctactccccacttccgcttaaccaccccaaatcaacctcccaaatacccattgactcattggctaatgcaccgtccaaccttcgcacgacgcataaatactgtagaccgctccacaaccatcaccacccactattcacccgtccgttgcgatgcaagtgcgacatttctcctcgtgtcgaatcgtccaggccggcaaagagcggtttgtgccctcctcgggaacctaccccaaggggttcaaggtcggcggctttttcaccggcgtgaagaaaaatgccttcaacatggatctggccatgctgtcgtccgataagccctgcaacgccgcggccgtgttcaccaccaacgtgttcaaggccgctcctgtgcaggtggaccgaaagatcctcgacgtaacccagggtaagggaatcaagaccgtggtggtcaactcgggatgcgccaacgccgtgactggagagggaggtatccatgatgcccagcagatggtcaagaaagccgaccaggtctttggatccgagagcgacctacctgcctcgcttgtcatgtccactggagtcattggacagcgattgaagattgataagattctcaagggaatcgaagagcacgcccctgccatgaaggacgaccatgaggcctggctcaacaccgccaagggaatctgtaccaccgatacttttcccaagctcatgtctcagcagttcaagattggagataatacttacactattgctggtctgaccaagggagccggtatgattcaccctcgaatggccactcttttgggtttctttgctactgacgctcccgtgtctgcctctgctctcggagttgctctcaagcatgccgctgaccgatctttcaatgctatctctgtcgacggagacacttccactaacgataccattgtctgtctggccaacggagccgctggaggtcccgaaatcaccgagacctctgcctcctttcctgttttccaggacatcctcactgacttctcttctcgactctcccagctcgttgtcagggacggagagggagccaccaagtttgtcaagatttctgtgaacgacgctgtttccgagcaggaggctgccaaggtggccgagactgtggcttgctctcctctcgtcaagactgccctctacggcaaggacgccaactggggccgaatcctgtgtgccgttggatactctggaatgcaggtcgagcccaccaagaccactgtttctttcatgcccaccgacggctcttccgagctcaagctgctggtcaatggtgagcccgagcaggtcgacgaggcccgagcctccgagattctcgacatggaggacctggagatccagatcaacctcggcaccggagggggcaagaacgccaacttctggacctgtgatttttcccacgagtacgtcaccattaacggagactaccgaacctagagaggactagaagcatccaacaatcatatacatataaaaaccactacgatcataagcatatggcctagtgtagtgcaatacacactctcaaacgtctatagaagagcctggttgtggtctctcaggtgattcacttaactgtcgatggccctcaagtctggcaaccctcgccaccatcgtgagagactccgttacactctaccgaccctctatatactctactagttctgtacctgttgggtgctcgtcctcactccacgtaaatgcaacagtgttttttgtacaataataaataaatggttatactgagcgtgacgtccgccacctcagcctttggtctctcttatagagctccaaggggccaccctgctcgtccttctgcaacaggtccagaattcgtttcgcttgttcccgaactagtccaccctcgaccgcttactaggcttctcatcgccagacatgggcgtcgaatccccctttcttctcttttgagaagcggtctttttcctttcattcttggtttcgtccaagtcaccccccgcacctgttttggcctggtgtttgagaaagaccgccgaggacagcgaaaacagccggtcgtcttcgttgaacacgtagcgctttttcgattgcgcgcccttgatgtatgtgtcgaagcccttgacgaggtttccatgggacgtttcctcgagatatgcgccttccagggtgaatatctgttcctccagcgagttgaggtttttgtcatgtgtttttttcttgttgatgttgtccttgagctgcttcttcagcttctcgtactggttcattttctggtcgctcattgtggtcgaatactgagaggttttcaatattggtggtgataattataattatcacgatacccgattggaatgcaccacatgtagtatttgtttagtagaaattggtcattgatttagttgaaaatgtcaagtaactctaatggctcagcaatgctgacgttttcgcctttgtacatttcgggctggcacgaaacgctaatattgggatggatatcaccaccacacgtctatcacgtctacacctccaaaccgcactacttggaccgccgtacacgccacactacacaccgtacgtacaccatgtcgttccggcaacagttccagcagggaggcaatcccaatggacagatgggcttcaacaacatgaacatgagcccaaacatgaacaacgcgaaaatcggaggcatggatatgggagcgcagatgggccagatgggccagatgggccagatgccacagatggctcagatgggccaaatgggccagatgggaggcatgccgcaaatgggcggacccatgggtggccagatgaacggcatgaacatgggtggcatgtccggagcaggtggcatgcccaatgtcggagggatgcccaacatggcaggaatgcccaacatgggtcagggtatgaacatgggccaaggaatgaacccccaagttggtcgaggtggacccatgggacctcagggtatgatgggccagcagggcatgggcggcatgcagcagggtggccaggtgcagatgggtggaggaccacagatgcaaccccctcagcgtcagccacagccacagcagcagcagcagcagcagcaacagcagcagcagcatcaccaccaacaacagcagcagcaggtgcctatgccgcaatcgcagctcatccctcagcaaggaggcatccccgtcatggctggaggtcaaccccaaaagaactttgatttccccccaccaggccagaccatgatgcagcccggcctcactgtccctcccgtgcagtcacatctgggtcttgtgagttccgatgacgcccgacaacaggagacacctctcgtgaaccctccctcggctgccgagtcgctcgccgagatgcccacgctgttcaacggccagggaattactgatctcacagagattatgaaaaacaaacgtgaccccaagaccgcccaagaactcaacctgcgtcgttttgtatccaaggatctcaacgagtcctccacgctgcccaaaaagctcaagcaggaggccgacaagctcaacgccaagcgatatgagatctctttctaccactcgtttggtcccattcgttcgcaggagccccagtccatttttcaagacggatacctcggctatggcaatggttggacaggtctcaacacacggttcgtgtacccccgtgaccgaaagaaacacaaccgaaacacccgggacctggtgctgtcgcgtcagcagatgaaccagcaggcggcagaaccggaactgctggtgcccattcgtcttgacttcgatctcggacgacttcgacttagagacaccttcatgtggaaccttaacgagaagacatatcccgtgcactttttcgtggagaacatgttcgaggacttccacttcccccaccagtacattcagtcggtcacaaactccatcactgaacagctgcaggatttccagccgcatcagtacccccaggaccctcgacacgtgattggcaacggagatgcgacccgaaacgaagacatgcgagttgtggtgcgcctggatatcacagttggtcagcacaatctaattgaccagtttgagtgggacatcaacgattctctcaactccccagaagagtttgctgccaccatgtgtgccgagctgtctctgtctggagagtttgctactgctattgcccatgccatccatgagcagacacaggtcttttcaaagtcgctgttgcttcttggccacacctttgatcagcgacctgtggatgacgaggacattcgacgtgagatttgcgctcccatacccgatggatccgtcatgagacccaagaactcggtcaacgagtactctcctgcgctgtttgagatttctgaggccgagctgagtcgtctggataaggacaaggaccgagactctcgtcagaaacgtcgacagggacgagccggcagacgaggcgcaccttctctgcccgatttcaagaaggttgtccgaacgttccgaactcccgtttactccgctgtgcttcctggagctgtcgaccgaaaggtggagttggctaaacaggcacttcaggcagaggaggaggaagaggaagaggacagtgatggaaacgttgtggtgcggcctgccaagcgacagcgaaccaccggtagacatgttccagtgcgagctgctgctgctaatgccgctgtggctgtggctgcacagagccaggagctggaaaccaactatgtggaggagctggcggatcctacttcattctgggtcactctgaaggtgcccccacagcagcttgcgcggctgatgatgattcctcggtttggataagggagggtagagggagtagctacccgcaaaagagattagctacagctaactgtatattaatagatgtatgagacaaagcagaagtctttggctagtcatgcgccagccaaaggcttgtgctgatggataatgaaggatatgtatcatatataagtatttgatggtaattgagggtgcaagtacaagtagttacgagagatgatgattcacgtggtatccaagtacatcatgaaaacgaatgtgtacttgtgcatagttcctgggccactgacattgctataggtatctacatgttggacggtgttacattcaatcatagtcataacttttattcatatttacacttacaaggtaaagtccttgagaagcttctggacctcaccaacagaagaggtcttgttggcaatcttctccttgagaatctgggccagatcctcaatcttgacatcagttcctcggtcagattcctcacccagacccagctccttgatcttgaccagaccctggggatactcgtcctggcccagaatgacggcaaagggacatccggccttctcggcggcggtgaactgctgggggtacttgggcttggttttgtacatgtactcggcctcgattccggcctcccacagcttgtgggtgacggccattcgctcggcgaggaatcccgtgtactcgggtcctcctcccatggacatgacgtagacttgggtagcagcaggtcggaccttctccatgagtccgggccgggacttgatgagcgagaaaagacgctcgacgccaaaggagactccaacacaggggatgttaccctttttggagttgttggcaaacatgccgaccaggttatcgtatcgtcctccggccagaatggagccaacaccgacgttctcggagttgtcgtcgtcatccttggacttcttcttcttcttgccatccttctcagcagcagccttgagggcagccttctgttcttcggtggggggagcagaggcctcggtcacagcctcgtagatgattccggtgtagtaatcaagacctcgggccagagacatgtcgaaagacaggtagtttgtgataccaaaggactccatgaagggcagggcagttcgcatctcctcgataccagtcttggcagactcgttggccataagggcagcgtctccctccagccactcgagcatgtccttgacagagcccttgtgctgcacgtactcgccaatcttgtcggcgacctcctcaggctggcccttctccacgcacatttccttcttgacgtcggcccagggtgccttgtcgagcttgtcgacggcagaagacacctttcgcacgtcctcctccttgactccgcagacctggaagattccgtcgagaatctttcggtggttgagcttgatggtgaagttggtgattccgagtgacgtcagaccctccacggcaatggccagacactcggcatcggggatcatggtggggtagacgccagccacgtcgaaatcgcactggtagaactctcgcattcggcccttggtcatggcgggctgatctcttcggtacaccttggcaatgtggtatcgcttgatggcctggattccgttctgggccacaaatcgggcaaagggcaccgtcagatcgtatcgcagcgatgtcagctctcctccctggtcctccaggttgtagattagcttggaatcctcgccgtactttccggccagaatctctcgcagctcaaagacgggggtgtcgatggtcacggcgccatgtcgcttgaacaccttggccagagtgtcgaaaatggcctctcgaacaaccatgtccttatcggcccagtctttggttcccttgggcaccttgagctcatacttgacggcctttttttccttcttgggggcggcctggggagcggcggtaggagcggcaacggcagcctcaacgttggcagcggacgacattcttcgaataacttgtgtgagggttctccgcagcatgtatgactgagctagcacaaccaaactttttcagttgaggttagggattttctgagtagtgcggcggccaacgttgtgcatgcgagacgagactggaagagatcaaagtctccgtgtcgaaggttgaagccggtaaattcgctggatgttgttgactatttatattgatattatgagttcctgttcgctatattagccaactcctgagttgtgttgtttagtgtgtggtattggtaataaagagatgagtcaaaaatatataaataaaatatataaagtatataaaatatataaagtatataaaatatataaagtatataaaataatatatatataaaatattatacttggacaagttacgagtttcatctacctgataaataattgtaagatatacgggtggtagctattgtactgatgctgtattgtagagtagattggtttgattgcttttcaaatatggccactgtgtctacacttcaaacttggagttctgattctaactaattccttctgttttacttaacctatgccaactaggatacaccacacgaatgtcacccaaccactcaacatagtggaaaaaaggggatgattatatcaaatatcatctcaattggcagttggtcttctttttgacccttcttttcctattttgtggcacttttcaagactctttggaaatcgtggcaaatccatcaaacctcccaccacacgcaaggttcaatatctgacatcaccacactctcacttgtgcccgtccccaaacaacacatcataatggtgagtattaaaacacgcaagaggtgatagccgctgttgtttgatgatacgttgtctctaactccaactgggtcgtggtcaacgtctcataaaccaacattgacgccgttgttatgtaatcgccactgacacgaccacacaacaacatcgccactgaacctctctaacacagtcacttctaatcacccccgaaaacacatcgcgaacccaggttaaccccgcctctttcggaaccggtgctccctctgtccagggtctccacgacacgatgcgagacggtcagctcaacattgaatcacagctcaacggacggcacccattacaagctcgtctggagaactgggaggagacacagatgaacatgcgaatgcaaaactacaagcgaacctttggtatgggtgagcctatccgacgaacaatggagatgcagattgtcaaggaaaccacccttatgcctgctgtggtcggtacccccgccaacatccacctggacattctcaagaataaggatctggacgtggactgggaggacgtgtacaccggcgacgaccagcccctcgacttccactccgagctcgagaagcgaatgggtatttagagtaatgatgatgtattagctagatggagaaagagaaaatgtgacaacatgtaaggaacctacgctaattgtctcatgtgtatcgtgtattaataatgctttactgtacatggggaactagtgctctctttacgcagtcagcctagttaaccctcttccaaacctgaatatatacctctttcaaatacaaggagtcctgtccgagctcggtaacatcagaaacaaccagatctcggacatccacccacgtttttcgtcccccatcacgcatctggacactccattccttctccttcttgtctcctccctcgcaagtgatgttggtgatgagattgtacttgccttccagtcccttggtgtaaggagccatgtccagtcccttgagtggaaagttgacaatcgtaccgttgtactccttggttccatctggaagggtggagaatcgcttgtaatgcaaaatgagatacttgggtaatgacacaatctggtatgtgtttctctccccggctagttcctcacaggttacaccatcgtacttttttagcagccttgttaatggcacatgttcaagggtggtatcgttatctccatccttgaacacggattccgctggcaagtcgagagtcagcagcaggaacggaatacatgttgttttcgagctcttgacatcgaaaacggactttccactcacctcccgctcgctcagcttttccgtcgtcttgttcaattttccctggaagatatggtgaatcaacgaagatcccggcttcgaacttcctcctagtcccagatgtgtctgtaccaacaaccagaccagaaactgacagggatcagcctggaagttggcggagaacttgccctgtgacagcttttcggctaggttcaccaactcatgtggactcacgtggttcttgaaagcccgtgggttccaaatgcgtctggatatctgtgataatgctgacacaatggcagactcgcttttggggtgcaacagcaagtagtttctcagaggctttgtgtgtgaaagaagttggacaaccacattggcgtagtcactgtgcttgatgttgttgattccaatgtaccctggtcgatacaccttgttggtcagtgtgtagctcgtcttgtccacatccagcctgttgatctgagactcctcatacacaggattggccacggacttgatgtcatcgagatcacgtgacgtctccttgtacccctccggaagtacgtagacctcgtatgtttccatgttcagaaacacatggtggtcgtcgttgatggagtgaaagtaagcatggcttgacttgcctcttccctgaaagtatctaccacataccaggcagcagtagacgttggtgggcgatagcgacacggagcagaccttttcaaagtcaaagtcgagtttcgatcggtccactgtgtcgaggtacagcgacgattcttggtgggttcttttttccattttctgtgatgagattggagatgttttggcgaacctgcaggtctaaagtgaatcaggaattttgggttggtatactacaggatctgggtgtgagcacgaattgtacttacttagacttgtgcttggaaaattacctatgcttagttgggtcttaacaaaaccacaactcattatcatcaaaaccgaaactcatcaacaaaatcagactcaacatcaacattgacaccaacagacgcagtgaagtcaaacaggttccccaaatccttattgaatagacccaagaagggtagatacagatatcgcaggtgtcgcagattctgaagtggctcacggacgcgatatttcaatcaacactacaccacgtgtgttacaccaacccatgccttgatacattcaaacttccatggatctgccaactgcccaagactttgtgcacgttctattcgaagctggtctcatcagacagatgcgggctcggttctccgaggtgtcgccatccccatccacaacgtgatttgcatgtgcaagtctgagagtcctcccatttcgagcgacccggcgttcctggagctcgttgatagagatgatctggctcgcttggctcagggagtcaagcatgtgaaacctcaagcctgttcaatctggcacttcctgctgagctcctgagattctgggtattcttgcatcactgcacaaccccaaatctaccagtgcgagggacgaacaggttgaggtcgacggagtggtcgtggctagacagatatttagcagtgatagacggttctacgaggtgtccaagctgcttcagacttccaaggtgcagtctacgacccttttcatccctctgactgcaacgaacaatgaggctctgacattgcaaaaggaggtggcaaagaccatcgttgtgcgaacatttactcttggtcgaagttggctgttcttctaggtgcgtgtacctttcactaccgagcggttccccattcccacaactcaacttcaacatgttactgcgacctgacaacgtcactgttcctcttgacaagtcgctgttgagtgaagatagcaccgcctgggatacttcgacgatggtgtgtcttcgggcttgagacgaatgtgtttctttggctctcgcgggctgttcgtgttgccttggtttggtcaggtcaacagcatcatcttgtcgccttaaacccctgaccatctctttcaatgatgaattggaaatcgatggttttaatagccggtgcttgagactttactttgttgtgacatctggcacggtgccagctacaaataccgatagctacacattcacttgtaaactagcggtgtctgagttctggatgtaccatcactcccaatacaactcccctaactccatcaccaaaaaagaacaccattgagttctcagagtttgaggcaaatgagatgtctgctattggcgctgatcattgtggtagtacgaacagcagacttttgaacgagccaatcgtgatatgaacttcaatgattgcgtaaataactactggctacattttatatttgtcagctgtgcaatcacacacctggcgttcctccaggttgcacttcctctccaatactcgctacgctcacattggccgcccatgtcacgtcacctcgcatactgtatgcacagtgcaatgggaatactgggccatatctttttctgggtttgcgggctccatggtgcaatactcagcaaaaagagtcacgtgggagctgcggccaatctctgcggcggctcttccgacctatggcaagtgccgaaaatgcatgtccgaaaatggggctggttcctgtgcatgaatgccaacgttgtgtgccttgggtgggacgttggctgagctaatagctagaccgaggagttgaaggagggaaaagggggtgtatatatagccgagtaaaaaaaaataaaccggcaaaagaggacaaacagaccccctgagaggaacacactgtgctcgtggcagctcatttccgtgcctctccccaacaagatgccccaactccgtctatgagaacaccactgaagtgtaccacttttagccacgcaggaggaccttgtcttaaacacagccttggaggccatgtcaacaggagcaagaagaatgaagacgaaggataaaaaatgagttgcagagacagatgtagcggaaatgaagatggtcggggcgtttggaatacgtcacgtgacccgtggctgtctcctataggccactctcccccgcctctacttaccccacatacagcagctcacctaaccctgcttgtcccagtgcgtgagaaaaaaagttgacggatataatggcacagtgaaaaatcttggaagcgtaagtgtacttgtagctaccttgagctcttgatccacacatcgaaacacaaaacgacgccagcaaaacgccctcaacaaccaactatccaacaacaacccacttatcatcaccttagcaatgtcacagtcttctctttcttttggtcccgaatggtgagtatattgtctacggactttaaaggtcaaggagcacgttggcggccggggtacgagtactacggaggcttgacagagcagacgagagtacgaaagcgtcgatatcttgagataagcacgtcatgtggcatgtgtgagtcacggagcttctacagagacttctccagggagctcttttttgggcacaggtacaatcaaattgtgtgtgtgattttgccttgacagacaccacggtggtatcctggtatggacacctcacgactacacttgtactgcgccgctgtgacacgacacgataaggacacgttatcatctgccccggcgccgctctcggtgtcgttatccaccactcatgtctgttatctacaccaacaccaactctgcctcagtcgtatcaccagtgtcgtactaactcaggatgcgcccgaaatccaaggcgcccgacggaaaaacaccactaccagctgtggttcccaatggcaataaggccaaaatggcgtggtccggagtcgccgcaggcaaggtggtcacgtctgtgcccactgaaaccaaaaaactgagttttgcctctgccgccactaccacccctcgcaagttcaagaaacgcgacctggaggaacccgaggatctgcgctccgatgtaggttcgggcttgttggctgaaaattcggagcccgtgccacccgagtctctgggtgacctcgcgtctccattgctgcccaaccacggaggacaacggttttcggccgaagatatgcttgcagtatggcgaaacatgaaggacaagaacgttctggtcaaaacggaggtaaacaaccaatccatgtaccagagcattcatctcaacaccccttcgctgctgcagaaggaccagggtgccggaggttcgctgatgtccaaggaccgagagggatggtctccattcaagagcgtaagcgtggtgagttcggttgaatctccctctcaaggacaccagtcactgcaccagccccagcagcagcaagcgcaacagcagcaagcgcagcatcaacatcaacagcaatatcaggccgatccttctgccccctcttccgctgccatgtcgcctaccacgggaacggtgccctcggtgtttgacacgttcaatgctcccgctgtgcctcccgggatgggttttacagcctccccacccaagttgcagcatcctgaaaacatcaagtggatgtacaaggactaccagggcataatccagggtccgtttgctggtcccgttatgcacacttggtggaagggcggccatctggatgccaagctgctcattcgacgtgaggatgacgacgtgtggcagaccgtggacgagctcatttctaagaccagcacccaggagccgttcctgacccccttgccgtttgttgctaagcaaccgcccgtgatcaatacgcagacggctttctcgcagcagtatcagcagcctggagtcccgcagcagcaacagcagcagcagcaacttcaaggccagcagcagcagcaaggaactccccagcaaggaggatcctttcagggctctacttcttccttccagcactatccccagcatctgcatggtagtgtatcatcctggggaagtcctgctgtgacccccatgtctcccacaccctggggtggttctcagatgggcggtcaggcgacccccaataacaatttcggcggtggaggctcgtttttcgaccagcccttccatggagggcattcgcagtcgtctttctttgacgacagaagcatgtggcgaagtggcagcgtcagcaacaccatgtctcctgctttgtcgcgagcttcgtccgtcattttccccaacgacggtccccatactcctacccgggccggatctcatactcctcttgcggctgctgcttccactgccgatgtgactgccgctgacaacgagctgcttgagctggattcgctgcccctgcatctgaaggatgtgattggagatgatttggaggaggttccaaccatcaaggaggaggagcctgagaagaaggagatgaaggacgagggcaaaaaggacgtggagcccaagaaggaggccaaggaagagcctgaggagcctcttactgccaaggagcgggccaagcgagagcgagatgccgccaagaaggagaagaagcggaaggagaaggaggagaagcagcgaatcaaggagaagatggctgctgagaaggccgagcgattggagcgggaggctcgggagaaggccgagaaggcgcgtcttgagcagctccggatcgagcaggaggccattgaccgggaggaggccaagaaagccgaggctgagaaggccgagcgggctcgacggattgaggaggagcgactggcaaaggaggcccgagagaaggaggcgccctggaccgccaaggagaacaaaaagaaggagaagcccaataaaatgtctctggctgagatccagcagctggaggagtttgagcggcagaagaaggaggccgaggaaaaggagcttgccaatgcgatccgagctattgaggaggctgagctgcagcaagagaattctctgtctgcttcccgagacgagccctctttcaagcccacctgggccactgctcctgtggcctctgctcctgccaagtctctgagccagattcagaaggaggaggaggctgctcgaaagaagaacacaatcactccggcaaccgctgtttcctcaggaggagtaaagaagtacgctgacgtgcttcctcggcgagcccctgtccccgctgctgctgctgttcccgacgctgcttctccctggactactgtaggagcccacggtaagcgaatgggagaggatggaatgcctgttcgagcccagacccctactgcccctgctgctcacatggctcaccagtacgccgcccagcaggccgctgctgctcagcatcaggctgctcttgcagctcgcccctctgcgccagtggctcccgctgcccccaaggtgctcactcccgctgagtctttcttgcaatggtgccatggagctctcagaggtctaaacgccggagtcaatgagaccgagctgatcggtatgctcatgactctgcctgcagaggaggagtccaccgagatcattgccgacattgtgtacgccaactcgtcgactctggacggtcgacggtttgctgccgagttcctcaagcgaagaaagattgctgatggtgactctgctgtcaaatggagcgaggtgattcagcatgccgaggttgctcctcaggatgatggatggaacaccgccttcaaggtggttggcaagaagaagcgggctccttagggctctttagggctccttagggcttcctcggaggacatgtatttatgtataagtaatgggcaattattgtacaatgagaggtacagacaccgtatagctcatacaaaagactacaagtactaacacaaaccgtacggaaagcacggacgctttctgagaaaactcctggcccttcgatgggtctaagtacttcttgtcctgcgagccatcgccataacccaatgtgcaatctgtctaaagataatacaaatgatcatcgcttcattatcaagtagtagggtctgacattcgttacaaagacccgttgctatcacattggttcgcagttagtgccagtcttcttctacacccactttatcgcttcactggatccatatcatacctccatttctatattgatctaagcgacaatgaccttggcctggaccaggtcggcatcaaaggccttctccttctcgttgagctcgttgactcgtcttcgcagaccctcgttctggatgatctccgacgcagtagcaaacatggtttgggcccagttttcggcgtatgtgttggcctcagcagcacagtcgttgagctccatttcgatcatcttctcccacgccgtgaactgatgcagcagatcatctccaatggatcccgcctcgtgaagagcagtcagatggggcttggcctccttggttttgatgattcgcttgatgttttccgccgaccgtcgtagaagagcggccttgagcaccttttcggatggacggggcgacgtatggtcccgcagagtgaagtagatgtctcggggaatgtgatcggggtaccacggttcgactcctgccaggttgaccgcctgccgggatcggtagatcttgccaaacacggccagcgccgtcacaagcacggcaaagtagatgaagggcgtgtagatggaaacgccgctgctgctttccattgtcggtcttttgtcggtctgttgtgtgtgtgtgtgtgtgtggtgttaacagaggtaacgttacgtgtgtctcgttcttgttagactctcttcgcttcggccacctatgaataactctatttgcactggagaaagaaggtgtagtataatcagctacgcgcgttgcatagacgaggctggagaggacgacagagtgtggtcacgtggatgttttttggttgcaattgtttttttaatggttgtatacgcgtcccgaggatatcgttgctttttttccagaaccagatttgggctattttggggtagttttagacgacagtcgaagaggttctagagtttatgtagttacttggctttgctacataatgatacttgtgatttaattagaagacatgccaatgtgggatggtattaggtaagccgagtgaagtgtttagagtctagttgtggctacaaatatgagtacgagtacacgaatttgtgtttgtggccaccagtttctgaaccgaccgttcaagcatccttttcattggctgtacacatgccatccgccattatgcccgcgcttacagtagtattatcatttaggctgctaattatactgtatgaaacttgtacatgatcatcagccccaaactaggacaccttcaaacggcgtttccgaatgtttaaagacccgaaatactctccttcaccactgtaatacatattgaggcaatatcttgacctcttggtacgatactacagacgtcacactgtctgtcgccatccagctactttttttatatatactgttttgttttttattttattgattctccaagtagagccaaatatctttaacaaactctaaatcctcactcggatatgcttgtcccagtggcaacaggaagctccatctcaacatcatctctatcaaccactactttcgagaatggtgagtactgcagacacaaacagctgtggaattgtgcccagactaactcagatcctgcgattccggtccaaaaagggcactcttcgagcggaggcccagcccacagatctcttcgatgtggcgttcaagaagctcactgaagacctgccagacatcgatcccgccacaatcacccttgccacgtcacccacaggcaagcaggaaccggcctctcgtcttctgggtaaaaccgtccagaagctggggcttaatcatggtgatatgctgtttgtcagctacacagactcggccccacgagctgctgtggaggctgtgacggccgaaaccgctccccaaatgaccgcggcacacattcgagacgccaccaaacaattgcctgtcgatgactatctcgagaaacaagatggaaagatcaagcgacagctatcagcactccagcagcgaaagtttggatccagaggtatgggcgaagacactcttccagtcgacccctgggacgaggagtatctcaaggagcagaagattaagcatatgagctaccatgcctacgtcaaaaagctcaattcgcaggcgaacaagaagaatggaggcggatacattgcccccctgaatgtgtcggatttcggagtgtccaagagctgtacaggagcccatgctccctggcccgaaggaatctgttcccgatgccagccctcggctattactctgcaatcacagccttttcgaatggttgatcatgtggagtttgcagagtcaggtatgatcaacagctttattgagccctggcgtcagtccggaacacagcgtatcggctggatgtacggccactacgaaccctacgaacttgtgcctctcggcatcaaggctgttgttgaggcaatctatgagcctgcccagagtggtgagtatgacggtatcaccattactgaaattacccaggcagacggtcagcctcaacctcctcatattgccactgccgaggcgtgtggactggtgcctctgggcgtcattttcaccgatctggttgatgctggcaatggagatggttctgtcatctgcaaacgacacgcggattcgtactttttgtcgtctctggaggtggcatttgctggagccatgcaggcacgtttccccaacaagtcgcggtggtcaccaacgtctgaattttcgtccaagtttgtcactgccgtgatttccggtaaccccaagggcgagattgatgtatcgtgctaccaggtgtctgagcagtgtgaggctatggcccgcgcagatctcatcgagcccagcatcaacccgtcggtgctgctggtcaaggaagctacaaagacacgatatgttcccgacgtgttttacaagaagaacaacgagtacggacggacggtgctccagggagccaacccacagcttcctgtagactacatgttggttacactgacccatggcttcccccaggaccccaggcctttgttctcatccggcctgtcgtctttccctgtggagaaccgagagctgattggagtgacccagagcccccaggcactaggaaaggctctggactctgggtctgctggaggagctgtttccaacttccatctgttgagctacattcagtccatgggtgtgctatctgctgaggagttccagttgttggccaaggtggctacggaaaagaaggatgaggacgtgagtcggttggttgccagtgagggctggaacaatctactgttgatcatccagtgatggacgagtatataatgggtgcattacaatttctatcatgccgactcgtgtcgtacagtacgagtccaagtatcatgcactacttgtagctactgtacaatcaaagtccgatccttagcggcgagtaaattgcaagtctagcagcatacagtaatgatgtcttggatgtctgatcatgacgtcaactttatcgctcgaaataccatttttgtagtccgttgagagccatattgcaactgtcgaatcatagcaactacagtatgacgagagcacatgttgttgccaaacaggtacggcagtaaaagtggcaccgtgcgggtactgaacaataatctatggttgccattgtttctgtaggaggagaatgttcccgcaccttctatagccacgtgcagcagtttggatggaacatatcatctcatctttcttgtgttgaataaatgtacgaaatcgcgataatcgaggccaattggcgaaatccaagttgttacagcccttttccgccgttgcccctcgccattctggtatcacacgccccatccgcctgatactgtatggttctaagacagttttggatacttgctctgaggcagcgctatcgatcagggatgacacgagcaggagatattacgcgggtaaccaagataatgctgcgcgatcttgtgtaccatatcgccacaaatgccacaaatgccacaaatgccccaattgccacttgcaccaggtgctctactagtcgccaactggaacctggaccggtactgtagtatccgccactgtactgtatcggggccggtcacgtgaatattaagattaaggttctgggttcgggagagttccacgttattctggagggttctaccttgttgtaggtggattttcggcggtcaaaaatgggccgaaaaaggcatttttttcttcaattggacaattggccagtggcaagagggtgagaatctcttgtaggcgcccgcgaccgtgtccccggcgtgattgctctcaactttttgaaaagtcaatttccgttaaactccagctacgacaaatataaaagttttcacgcccagctacagttgagtgttaaaagtacagggcatctacaacctagccatatacccattttatcacaacaccatacacaatgaccacccccattggattggattttggtaactaccactcctacgtctgcgccgcccagcgaggcaacctcgacgttctcgccaacgaggtgtccaaccgaagcacaccctctcttgttggtttctccttcaagaaccgataccttggagagaccgcaaagtccaacgaggtgtccaacctgaagaacaccgttggttctctgcagcgaatcattggccgagccggcgatgatcccgagttccttgcccagcagaagtttgtctcttccaagctgctccccgtcgacggccaggccggtgccgaggtcacctacaagggtgagaagcgacagttcaccgccacccagctcaccggtatgtacctcaacaagatcaagcagaccgccatcaccgagaccaagtcccaggtctccgatatctgcattgctgttcccgtttggttcaacgagcagcagcgacttgccatcaaggacgctgctgccattgccggtcttaactgcgtccgagtggccaacgacgtgaccgccgccgctgtcggatggggtgttttcaagaacaatgatctgcccgttgacaagcccaagcttgtctgcttcgtcgacgttggacactcctcttacaccgtgtccgtcgttgccttcaagaagggagagtgcaaggtcctgggtaccgcctacgaccagcactttggtggccgagactttgatgctctgattgctcagcactttgccgagatcttcaagaagaagtacaagatcgacgtcaacaccaaccccaaggctgctgcccgagtcatggcccagtccgagcgactcaagaagattctgtctgccaactcttctgctccctttaacattgagtccgtcatgaacgacgttgatgtctcttcctccatgacccgagaggagctcgaggaggctgctgcccctcttctcaagcgagcccacattcccgtcgaggaggctcttaagcgagccggtgtcacccccgatcagctcgacaacattgaggtcattggtggttcttctcgaatcccctctgtcaaggaggtcctgtccaaggtcttcaacaagcctctgtcttacactgccaacgccgaggagtccaccgctcgaggtgccgccttcatctgtgccatgcactcccccaccatgcgagtccgacccttcaagtttgaggactacaacctcaactccgtcacctactcgtggaaccccgttgagggcgaggatgtctctgagctcgaggtcttccccgagggaggctactaccccaacaccaaggtcatcactcttcaccgagctgctgcctttgatgttactgcccgatacaccaaccccgacactctgcccgagggaaccaaccagttcatctgcaagtggaccatctccggcatgcagggcaaggagcccgctgtctgcaagctcaagctgcgacaggacccctccggcatcttcaccattgaggacgcttacgttgccgaggaggttgaggttgaggagcccattgagggagccgagcccgctgaggagggcggagagatccccactcagactgttaagaagtgggtcaagaagaccgacctcaagatcgaggcccagggcctgggtctgtctcagaagcagctgcaggagcagattgagctggagaactccatgatcatggaggacaagctcgttgctgacaccgaggaccgaaagaacgccctcgaggagtacatttacgagatgcgaggcaagctggaggacatttacgctgactttgcctccgacgccgagaaggccaacctccgagagaagatggagaagattgaggactggctctacggtgccggtgaggacgccaagaaggctctttacattgccaagtacgaggagctggcttccatcggaaacctcatcaagggccgatacaacgccaagcaggaggaggagcgacaggccaaggttgccaagaaggaggctgccaaccaggccaagcttgctgagatgatggctgccaagcgaaaggagaagaaggatgccgatggcgatgtcgaggttcccgacgtcgagtaaattaaaatcgtatagaaatattagatgataaggaagaccaggtgagcgtagatgacgtagtctgtgagagaattgtgcgactgtagatcatgcgatccgtatgtacgtgatcgtctccggacagggcccgacacttctacatactactcgtacagcacgtgtaggtgatcttctcgttcatcggtgacggtcacttttcacgcagctctagtctaataggacagtttcgatactatcgtttgacgatacgggttcattggagctttctactttgttagtttccattcaatgctcttgtcggtcttgaacaaacgctgaactgttggattcgctcgggcttctggcatagtgtggagctatatgcgaatattcttcaaatattgaagcgtcaattgcatgagtgtatatgaactttcacactgaacaattaattgtccgtcggcttggggattcttgtgtgttgtagcgttcaccgctgccataaatagaaatggtgtccgagaagactggagtttctatgaagcagtgtaatgtcagagaagagtgaagttgaaaaacttgagagagcaagagataacttccaagaaaatgtccgggattagctgttcctgtcactcaggtaagaccaacctgctacaagtactgtaaaactactatctgattgtgagatgtggctacatactgtgatatatgaaaaatgtccatactgagactaggaaaagatgcatcactccaactgtctccatctgttgcggagttgtggacagggcagttctgccgagtatactgcggagaagccattgtttgttttttattcttattttatgcgtactttattcgtattttatttgtttttattcttattttatgcgtattttatttgtttttttattcttattttatgcgtattttattcgtattttatttgtattttatttgtattttatttgtattttatttgtattttatttgtattttatttgtattttattcgtattttatttgtattttattcgtattttattcgtattttattcgtatttttcaattctggttgacacattatttgaccaacgctcaacctcctcaaaagatatctcctgaaggactcatgatgagtccacagatcgaccctagactgatgttgactacgttgtaattggtatgctccaagtgtagctagattgcaagtactgtactaattagtaactacttcgaccagaaaaaacggaccatcactctctgccaaacatgccccgtccataggttccatgtggctcgtttggcggccattacatttttttgacgtttcgcagcctcctataccccgttcccacaaggttgctttttttccctttttttcccttttttttctctttatcctcttatttatcatcgctctcgggttaagtaccggtcgtagcgtgacaatccgaacgtggtgcgcctaccccatgtggacaaagaggtataaatacacgccagtatgacgtcgcaggacacctgaccgttacagccaaagcaccacctactgtacgatgcgatacagtacgaaagctccagcgacacgttaacggcagtaccacaactgtgctcgactcaagctcacacgccacgttgcatttgacatgtatatgctgtagacgtgggtgctagcggtcggagagatgtttgtgggcgtttcggggaatgcgtgcgagtcgccaccgttgcgcaaaatacccctcatcagaccctctcctcttgtgctggtggaggtgataaattgcacgttaccgttacaccgattggagtgggtcgtgtgccacgtcacaaaggtctttttttttttttctctgcaaattaacatcggtcaaccctatgtgtgaggttaatgtgagtttggatttgtgggtaaattggttgtacaacggttgtgttaggggagggggacaccaagagagggggacaccataccaagatggcgccagatggttgtctccaggggagataattgaccctggtctcggctttttggtcgtctaaaaccaccgccaccggcaacccagccttcgactctttttcaccaagttgtacagagcgttttgggttggagctcagatcaaattttatggcaaccgcgcatgactggcgagtctaacacaggtgaaagaagagatagctgagggatatggtgtagataaggggtgtccgagggccgtgttagcactccagagagagtgcacatggagctcgggctggggtctcgaagcgttgtccggcagcttttttgccacccccaaaactgaacatcaccctttgaccctgtcccacaatcagccgtatacttgggttcagcaactctggatactacaggaaaactatgcagagatccaaccacacacggccaatgtcctctatggagctgcgtgggagatattgggtaagtcctaagtggctggaaaagggggattgagcccgcgtcctaggccatggtccatcccgttgctctcaatgccggcctatagaacgggttccaacactacacacacccactaatgcacccctccccctcgtgttagccgaggagagatggtatgagtgagtagacaagaagagatggtgatgaccgagaacgccgatagtatcagcgagatacacgccaacaaccaaacaacttggttgccctcaaatcaagcccctcttcgccattcggttccttccagaccattccagatcaatccacctcttcttatctcaggtgggtgtgctgacatcagaccccgtagcccttctcccagtggcgaacagcaggcataaaacagggccattgagcagagcaaacaaggtcggtgaaatcgtcgaaaaagtcggaaaacggttgcaagaaattggagcgtcacctgccaccctccaggctctatataaagcattgccccaattgctaacgcttcatatttacacctttggcaccccagtccatccctccaataaaatgtactacatgggacacaacaagagaggatgcgcgcccaaaccctaacctagcacatgcacgatgattctctttgtctgtgaaaaaatttttccaccaaaatttccccattgggatgaaaccctaaccgcaaccaaaagtttttaactatcatcttgtacgtcacggtttccgattcttctcttctctttcatcatcatcacttgtgaccatgagtgctcagaaggaagccgccattacgcacaagacgctctctgagctctttgagaagctctctgtcagcgactctctggagtctcgacttgaggctgccaacaacgttgccacctttgttaaccagggcgacgtgattgagcacgatgttcctaaccagctgctggctgccaccaaggccaagctgaaccagaagaaggaccaggctgccgttctcaacgctctgcagctgctcaactctcttgccacctcctcctccgttgcccccaacgtggagccctaccttgttgaggccatcactgatgtgctcgccaaggtcggtgacaaggacaagcagatccaggacgccgccgccaagaccgccaaggatattgctcagtgcatcactcctcgatccgtcaagttcattctgcccctgatcatcgagtctcttgttaacaccaacaagtggcccgagaaggttgctgctctcgagtgcatttccatcctggtcaccgttgcccgagaccaggttgccctgcgaatgcccgagctcatccccgtcctctccgaggccatgtgggacaccaagaaggaggtcaaggagcaggccaccgccaccatcaccaagtccaccgacaccattgacaacaaggatatcatcaagttcatccccgccctgattgcctgtatctccaagcccaccgaggtccccgagactgtgcacattctcggtgccaccacctttgtgtccgaggtcaccaccgccaccctctccatcatggctcctctgctgtcccgaggtcttgctgagcgagacaccgccatcaagcgaaaggccgccgtcattgtcgataacatgtgtaagctggtcgacgacccccaggttgttgctcccttccttgagaccctttaccccgctctcaagactaactacgccaacattgccgaccccgaggctcgagacgttactctgcgagctctcaacaccctgaagcgagttggtgagattgttgacgacaagatccccgaggtttccaccgccggtgacaccaaggtcaaccttgccatcctcgagaagctgctcgagcccttcaaggtcgacaccaagaagttcggcctcatgatgcagttcattgcctccatctccggtgacctcattgacgagcgtctcacccacgaggccgactgggccgagtctctggttgccttcatggttaccattctccccgagaaggatgctcgaaccgtcattgagtctctccgaaagcaggccatcgccaacatccccggtgccaccaactttgaggaggaggacgacgagggcgaggatctgtgtaactgtgagttctctctggcttacggtgctaagattctgctgaaccgaacccagctgcgactcaagcgaggccgacgatacggtctctgtggtcctaacggtgctggtaagtccaccctgatgcgagccattgccaacggtcaggtcgagggtttccccacccaggaggagtgtcgaactgtcttcgtcgaccacgacattgacggtacccacgccgacaccaacgttgtcgactacgtccgaaagaccgccggtgagtccatcggtactgaggaggaggtccgaaagcagctgcttgacttcctgttcactgacgagatgacccgaatgcccatcacctctctgtctggtggatggaagatgaagctggctcttgccactgccgtcctccgaaaggccgatatcctgctgcttgatgagcctaccaaccatctggataccgtcaacgttgcttggctggtcaactaccttaacacctgtggtatcacctccatcatcgtctcccacgactctggtttcctcgataacgtctgtgagtacatcattcactacgagcgattcaagctccgaaagtacaagggtaacctgtccgagtttgtcaagaaggttccttccgccaagtcttactacgagcttggagcctccgagattaacttctctttccccgagcccggtttcctcgagggtgtcaagaccaagcagaaggctattgtcaaggtccagaacatgaccttccagtaccccggtaccaccaagccccagatccgaaacgtctctttccagtgctctctgtcttctcgaattgccgttatcggtcccaacggtgctggtaagtccactcttatcaacgtcctgaccggtgagctgctccccacctccggtgaggtttacgcccacgagaactgtcgaattgcttacatcaagcagcacgcctttgcccatatcgactcccatcttgactccaccccctctgagtacatccagtggcgattccagaccggtgaggatcgagagaccatggaccgagccaaccgacagatcaccgactccgatgaggctgccatgaacaagatctacaagatcgagggcaccccccgacgagttgctggtgttcacgcccgacgaaagttcaagaactcttacgagtacgagtgttctttcctgctcggtgagaaccttggcatgaagtccgagaagtggatccccatgggttccgtcgacaacgcctggatcccccgatccgagctcatggagtcccactccaagctggttgctgaggttgatatgaaggaggcccttgcttccggacagttccgacctcttaccaagaaggagattgaggcccactgcgccctccttggtctcgagcccgagcttgtctctcactctcgaatccgaggtctgtctggtggtcagaaggtcaagcttgtgcttgccgcctgtacctggcagcgaccccatcttatcgtccttgatgagcctaccaactatctggatcgagactctcttggagctctgtctcgagctatcaagcgattcgagggtggtgttgtcatcattacccattccgccgagttcaccaaggatcttaccgaggaggtctgggccgttatggatggtgtcatgactccttccggccacaactgggtctctggtcagggatctggtccccgacttggaaagaaggagggtgacgaggaggagaagttcgacgccatgggcaacaagattgtgtccgagaagaagaaggccaagctttccgctgccgagctccgaaagaagaagaaggagcgaatgaagcgaaagaaggagcagggtgatgcttacgtctcttccgatgacgacttctaaaatcaaaattagtagccaatagattatgcgaagaaaaattgatatttgtaattaccactcgcggcctgtagtctctcttgtattattgtacttgcactgtagtacttgtatcgtgatcggtgtgtcttgaagatcggtttttctattcattttttggaaggccaaaactttggagccgaattcactgaacaatagtgatgacatatgtatttgaaaaaggtgaatgaatcaaacattttgaacacgatatacatactcgtcaacaactttcagtcgtttcacagaaacttgatctctattggtgactcttctgtggaccaagtccatatgaagcagtatgagctctacacgaccaaaaggagtcgtcggtgattcgagtacattttgatattaatttaatacgcatattgatctagttccatttatatctacaagtacgagtagcggtaccaatcatctgtgtaatcatcactcgtacaaggtgtgtttcatactgaaaattctttcacgctctccctgataattgcagctatatgatgcgaaggtttctcatgggaagagtgggcaagagaaacacctgtcggggagtatcccactacctcatcattcattatacaataaataaatgttattacaagttatgctactcatcatcttcttccccttcctcttcactttcctcatcttgactctcctcctcactctcctcgctttcgctctcactaacgtcaataagaggttctctgggctccaactgctcagcatcttcgagggtcagtcgtttaggcagtcgaggcaatgcaatatcacacactcgctcctcgtgtaacagatcatcaatgaactgatccatgtacgtcagagtcacgccacccatgtttctgaaccgcagtttccggtagtctcctaaaagtggttccaaaagagtgtatattttcacgggggggtatgccagccgaatatagaaggctgccaccgctctcaggtacttgaactccttctggttcaagtactccatgataatgtcgtggctgggctggatctggagcagtttgaagaccagacacaaaaacggcgtcggtttttgattcgcatactggcctccaatggccgtcaatgttgctgctcgatcacacagagtggcggcattgagattgaaacacagctctttccagtacagtgtttcaaagatgcgttctctgatgatcttttcaatcagtagcgccgggtttattccatgaatcgacagtgcgccgtgcaccatgcccctgtcggtgatataggtgtccatggctgttgtgtgtcaagggtggtacagtagtgcgtaggaaaaagtggttctttgacgcatgttggtgcactgttaatttaagttccccgataccattgatccagtagtctgatcagaatgttgatccagcagagtagctgtagttgtacgcgtactcaagaggtcggcaagtagatgtgaagctttggagtcaggtccgacaatcagatctgtggaccaatgagttcttacgtacttgttcttgtacttgtattttgttgatatggtcgttttatacacatcagtaaacggctatatattgttacgaagtaaaagtatttgtacaagaatgtcaaaagttgggcttcgagggagaaaaaccaactctgacgaagagaaacaatccaggagttttcttgctttttcacctctgcctcctacccacactaccgcttacataatacccccgtccagacccacacgataacagctgcaggctcctgcactctcactctatctttagcatctgacaacaccatggaagcaatctacgaccggctggcgaaacgggctctagacctgtacgaacacaaacagcgtcgggtgatcatcacgctcgtaggaatccccggctcgggcaaaaccacctcagcccaaaaaatcgccgacaaaatcaacaccatcacacacaagcccgatctcagtatagtcgtacccatggacgggtttcattacactcgaaaggagctggatgcaatggatgatcctgccgaggctcaccgaagacggggagcgccattcacgttcaacgcccaggccttggtagatcttattgccgatttgcatactgagaagcccggcgttgaggtgccgtctttcgaccatgcgaaaaaggacccaggtcccggcttcgtggtccattcggaaaacaagattctcattgtcgaggggctctatcttcaactcaactacgagccctggagcaagatcaaccagttcgttgacgagcggtggagaatcgacattgatttcgacaaggcgaggcaaagagtgggaaagagacacgtgggagccggtctagcagacaatctcgaccagggactggaaagattcgatatgaatgacggacccaacggaaagcacctcttggagaagagtgtgaagccagaggtggttgtggacagtattgatgagagctctgcttgggctgattgtggtggagagtgttaatctacttgatactaccaaaggatgcgcaatccaacgtttataaagagctcttcaccgccctcaggagtgctatgtccctctaacatcagctgattagacattgtacggtgatgtaatcatgctaggatgtgtgagtgaaacttcttctgtccgaggtacttgtttactgatcttgttgacacacatgatctggaattactctcttattaatgtatggaattataatgctagtctccttcctttgcctgtctctctagactcggggctaatcactctcgtagttctcatcctggtatcctctcaacatgagcgatgtgtatctcagatagtcatgcttcatgtactgaggcatagcgcagttggcgggataccaatagttgacactcacattggcgtcgtcttcgggggtctccacaatctgcacctgatgataccacagcgaaggaatgtatagaacttctccctcatgcaactccaccacaaacggtcggcaatactttctgtagatggggttgtgggtcttctcatcggccgggttaacggtagggaaaagcgtcttgggcatattctcatcgttcacaacattgtaccccccttgaccatcaggtacatatgtagctgaagtcaggaactgctcatccagacagtacacctcggtaggagggatcaagtagaacttcttgattcctcgcacttgtatatacaggttctcaaatgagtcgcaatgcagtctcgaggtggttcgcgtgtccccaacccacaagttgaccaattcaggcactcctagaacctcgtctgcccattcaaagttgtccaccaagtcttccatcaaaattttgtaggctgtggccatgcatccatcctggttctgcaggtatcgcaccggcttgtggctgtcaaagctgtttgatccctgcagcgaatcgacaaactccccaaagggcatttctgccgtgtggggcttgacaaacacagatccgtcagttgtgttgagaggcgaatccgcgtttcccagcggggtttccgcgatactcactaccaggttctcgcccagtttctccttgaggtaggctgcgttccatttgccaaaacacggcaaatcaatcttcttgattaccatgggaaagcccagacccacctgtttggcgagctgggtgggcgtgggaggcgtctcgaactcggagatttccgcgggcaaaaacacctgttggagctccatctgcttgagcatgcccttttcgagcttttcgtgtgagaccatgtttggacgtgtttctgatccgtttcaaatgccgtcttgtgagtccggaggctgtgtgaaagacgagtgtgtcagttcaatcccgtgagccccacttgccgctatgtcgcacgggtcctccagaagtatcgtacgttgctagctgtgactgagcacggggtgcgatgtctgtttagaaaagtatgcagctggtatgtgtaacactcgctctggagagttagtcatccgacagggtaactctaatctcccaacaccttattaactctgcgtaactgtaactcttcttgccacgtcgatcttactcaattttcctgctcatcatctgctggattgttgtctatcgtctggctctaatacatttattgtttattgcccaaacaactttcattgcacgtaagtgaattgttttataacagcgttcgccaattgctgcgccatcgtcgtccggctgtcctaccgttaggggtagtgtgtctcacactaccgaggttactagagttgggaaagcgatactgcctcggacacaccacctgggtcttacgactgcagagagaatcggcgttacctctctcacaaagcccttcagtaccgccgcctgtcgggaaccgcgttcaggtggaacaggaccacctcccttgcacttcttggtatatcagtataggctgatgtattcatagtggggtttttcataataaatttactaacggcaggcaacattcactcggcttaaacgcaaaacggaccgtcttgatatcttctgacgcattgaccaccgagaaatagtgttagttaccgggtgagttattgttcttctacacaggcgacgcccatcgtctagagttgatgtactaactcagatttcactacctaccctatccctggtacgcacaaagcactttattttctcacatctggtggacgacacctcgtttttgtttcgagtgatagcctgccagatttattgtgcctttactgtcgtaccagcgtattttacttccctttccgttctttcgttttcaccatgtcgaaagtaacaaaagacgagttccaggctctcaccgcgaagatggacgccttgacgctctcccaccaggagatcaccactactctcgctaccgcggttaataccaaggaattccgctcagccttagacgagctcaagcagtcaaatgagtctttcaagacacatcaggctggggagtttgaaaagttgcaccagttggtgtcggcccagcacgaaaccatcgcgaacctcagcaagcgtgtcgactcacccccgagcaccagctcccttgaaggcatttcccgtattggcaaggctgattccgaatttgaacccgacaccccccagaagggtaactctgtcctacatggcatggactttgctgccagtgacacgggttctgttgactatcgaaaagaatccgacgccctcaagtccatcatccggaacgaggtttacccctccttgtccagcgaagaattccgaaaacagttgtacgcttacaaatcttttgattcccgggtggctacctttatcctactccaggatgacatccgttggagcaccagagctcgggctttccacctttggtgcggtgtcaacgataagcagcccctcttcgatcaacagtacctccaactccgaagcacctttgaagcagagactgctgatgaatcaaccaagccaggtgcccacgctcgtctgaacaccgcttgcgaacgtctcctccgggacctttttcgaaagcgcgggtttgaccacgaacctgctgtctcctttgctgaacaagaggaggaactccgtttccggttcaaagattaccacaccgctttctctatcgagacactacgtgcgtacctctctgctctgagcaccgctctgacctcctcacctctgccggttctctctcggtgtctccagttgcagaagctcgctccgactcacctgggcaccgccctcggacgcgagatccctcgtgacaacactcgttggctgagccttggcatggactccgaccctgagcgtgaccatcaagttgccacggagctcatccagcccctcgccaagatgatcacccaacatgtccaacgacttgacgatctcaatgatgaggctcttctgagatggcgacagcacacggtatctttcgaagacgtgtggatgtgggtcgagccttccgccccacctgagccttccacgcctgaacctgacaaagtcgtcgttcacgttgcgggacgtggtcgttccaccaggaagcctgccgacggccctgtctcaactgagactgtgcagaaacccacaatccgtgcctcggatgcctcaacctcctgggcagctgacaaggctccttgtgttttctgtggttccactgcccatgcactggtcaactgcgatgactccgaaggcagccccttggtcaaggccaagtaccttggcagcttcaagtctttcacccgacttggctaccagggttttgaaaagtatctatcgcctgttgatgctgacttccctctaaaacagagcgctctctacacttcctggaagcagaaggaatggtcgaatccgcttatggagcctagacttcgaactttcaatgcgcagtggcgtcctgccctagctggccgcgtaaatgccgttgaatttgtacacgttgaagacccaggcgggcctttggataacagctatgactctgactcatctgcgtctggttatgacttccaggaccttctccaacccggcacgttcagtgtctgtctaggaggggtgcctcgagatcttctgtctgatacgttttcctcctacgacgagcctcgcactatcattgactccactgactcccagcttgagctcacgaaagaggcaatccaccagcacattctccagatggaaaaacagcccacacccctccccgtcacttacgcaattgatgcgcctgtgtcaggctcctacagtggcaacatgaagcgccttgtggcacacccagccttcatgcagctcgtagctcgcttaactgctcccccgggcacgttcaaagcctccacgcttgaagcgggttttgtaggtgctgttatggccccgtcttccccagttgccggccgtgtctactttgttgatgcggtccagcgattgctcaacaagtacaacgtagtattgcctacgaagctttacgagtgtttcgctacagtccgaaatgacctcatggagcccgcttacgccaccgaaggcgatcctcgccgacagtctctcaagaccaacatcaacgccttgaaaactgttgtcgacagcaagcaccctgacagaccagtggctccgttgccgcgacgcagcccccgtcgtgatgtccgtgaagacatgcccccgcctgctttgcctcaagcgacaaaacgtggtgccgcttcttctacggtatcttccgctgctccccccactgctaagcgaaccaaggctgtagccaatccctcctcagtggggccgactgactccgcatcctccacgggcgctgttgttgacgtccccagctctcgtgtggctgttcaccccccccgtctgggtgataaccactacgtgagccctggaacccgtgtcaccaaccacatccacgatgcctctgccgttgcggagaatgcacccttaaaagattacaaggatgctctggaccgcctcccgtctgacctagaggactccaaggctctcttcaccagagatcatcctcgttacgacaatgccttgctgaaggctgggcgtctccctctcttcaagcttgaggccattcatgctctgccggaatcggaaaaagcagacttgtttgagcgcatcctcaaggcgtcggatgttgatggcctcgttctttttgagcttctccaggtgtgccctgacctcacaaagtacatttggaagaacttccgtcaccagcggcaccggcttgcgggtcctgacatccaagccatcgctcttgagctcggggacgatctcatggagtgtgccatggatcttgcgctcaacgtgatttcgtccacaccgtatgagctcaactctggcaccttcggtcgtcttcaggaggttttcaccaccattgaccgtcagctgtacgacgacaaagttggtaggccactctcgccccacttcaccgacaacattgctcttttcgaccaacagaccagcgccctttttgacagtggctcgtctaacaacgtcatcgacactgatttctttgcccttgtactcgcgaaggctggtgtcacccctgaccgggtgattgttttttctgacggacagtcccacgccacagtcgcaaacggagccaaggtaaaagttgatttctgggcgcttctccctgtcactttcctgggtgtcgttactcttgaaacattttgtgtcatgaagtgcagcatgaagtgtattctcggcaccggatacatcagcaaactgcgcatttcgttcgaccatgatcgttaccgtgtcgcttcagtggagaaccctggtaaccctggcgtccggtgctaccctagtgacagaccttcagctggccttgttgctcaccttgggttgcttgaccgtcttgtgaggcccggccgccggcctgtgcctgcgtttcctgctgccaagctgtctcgccaaaacgtcatggcacacgttcgacccactccctcactctgtggtgatgttgatgaagcaacaaatctccttgacgcctcatctctcggagggcctcagcctggatcttactcccaccgttctgaaacagcggcaggctgttttgccatatcctttgctgatgactgtgagtctgccggcccgccttcgagcgctgccaccgccattctcaaggctctagcgtccagctccggccctgatccccttggcattccccctcgtgatgaccctgacgagtcttactcctcatcacctgggcaccacggtgatgtctctggcgagcccaactcctcatcacctgggcacacctccgctcccgtcgacggtacgcttggacctttactgcctaccgatgcctcatctgtggatgactccaacgagctctgctcctcctcttcaggctcggaagccccgtcggaagccccgtccggagtctcggccgccttgtcagatgtaggcaccgttttccaggagagctacacgtcgtaccgtttccatgacaaccttgcagacaatgctcttcatgccagaccccccgacgctcatgctctcagtggttttatttcttctgccgacctcgacagtgttttccagtatccacctcctgcatcgccctgcagctgctgccagcagcctgtacgtgagtgtcgtgtacttggtaacactgttttcatcatggctgacattggcgactcggctaccatcgttcaggttcaaccggatactgacctgtccatgcgccaacagctctaccttgctgaagttctcagtgatgcccaagaaatcacccctgaagactctctgcattctttatctgtctccgtcaatgccatgtacaagccgctacacaagcgttctctgcctctaaataagcttcgcccggacggttcctttcctgtcggtgacggctccaagccttctccgcgacatcgcaacttctctggcgacgagtcttgccaatttgatgccaaacttgctccagtccttttcccggccgagcttgctctctgtcgccatcgcatgtcggacacggagggtgtctgggctttcaacgaagaccaggagggtgtcctcagtcaccatattgaggagcccaccaagatctacgtggaagagggaggcgttatcaactcaaagcacttccctctccgcggggctatggtcggcgctgccaaagacatcatcatgaagggtctcgccaacggccagatggagcccagctcctccccccaccgcaacgcctggttcctcgtgagcaaaaagagctcgggataccgtttcatccttgactgccagggcctcaacaagatcaccttgagagatgctttccacccacccaacgcggacctcctggctgagagtttctgtggtcgtgctgtaacttccctgcttgacattaagaatggttacggtcagaaggagattgctcccgagtcccgtgacttgacggcttttaacacagattttggctcctatcggttaacgcgcctgcctcaaggttggtgcaactctccagcggtgttccaccgtgccatgctgcgcgtacttgggcccctctttccggatcaggctgttgttttcttggacgatattggcgttctcgggcctaagactgactatggcggagccatgcatgacgactttccgggctgccgccggtacatcgtcgaacacatggacaacctcatggctgtgcttcagaatctctatgaagcgggtctgactgtgtctttcgacaaggccgagcttttcgtcagtgaggctgagttcctcggtttcctcactacctctgaaggccgcttcccgtcccctggcagttccgagaagatcgaatctttcgagttccccactactgtccgtggtgtgcgctcttttctcggtgctgtggtgtattttcgcatgtggatccctcatttcagcagtatcgctgcacctctgtacgactgcatctccgctgcgcagaaggctggcaaactcaagatcaccaagaccgaggccaccgagtctgcttttatggcgctaaaaaaggctatggtgagccctgcggttctgcaccgctacgaccccaccttacctattgtcatcaccactgatgcgtcctccctcggatggggcgcagtaatgtctcacatcgtcagtgttggccctccggctgcccgtcgccccgtccgtttcgagagtggtttgtggaaccccactgagcgtacctacgcatccaccaagactgagtgccttgctgtaaaacgtgccttggagaagtgccgtcactatgtcactggcgttcatttcgtgatcgaaactgacaaccaggccctggttttcctactgcagcaatcccgagttgaactccctaacgctatgttcacccggtggtttgcttacatcaaacagtttgattacgaggttcgatttgttaaaggccgagacaatccagtggccgattggctgagtcgtgagaaattttctgacttccgacctgtcgattttcgccctcctgttgctgatacagctcgacaagctgatgagcttgctccgcttgtgcccccgacttggtcccctgtggcctccatcactgtcctgtccattggtccagagcccgttttcatccacaaaggcatctctctcgatctcattttcaccaccattgcctccggcgatcttgatcgagatggtgttgacattccgcctagactgcgtcaaatctgctctgagttcttcatttttgacgacattctcctactgatcagctcacctggtctccatcgacgtgttctcttcacagagaaggaggtgtctgaggttctccgagctacccatgaacaatatggccaccgcggtgctgctgccatccttcatgctctccgtcgcctctattactggccgggcatggctgatcacgtgaagtcccatcgtgcatcatgcggcacgtgtgcaaaagccaccaaccatggtcttctcaaggcgagtctccacttcgtggttccccgtctcatttgggagacagtccagctggacatcctctaccttcccgctgttcatggtcccaccaaggagtaccccgatctggctgatcccgccaaggctctcgctgctcaaaccaccctcaccgacttcctccccactgcccctcagttcactgatgtttcctctgccccccgcggacggctaaatgtcactattgccccctaccagtatgtccttgtcgctcgtgatgaattctctggctggcctgaggcggtgcccttacgaagtatcaactctctctccacagccgctttcttctacgatttcatcattgctcgttttggcgttccccgtcgggtctacactgacggtggtagtgagttcaagggtgattttaagcatctctgcgaagatttccacatcaagcaggttttcaccactcctgctcatggtcaatcgactggcattgtggaacgcggtcaccaaaacctcctccactgcctgcgcaaatacggtcgtcagtggatcttatacctccacaccgccctctgggctgaccggtgcacccgtcgttcatccacgggtaagtcaccttttgagctgatgtatggtgtctctggtgtcttgcctgtcgaaagtcgtttcctgacctggaattacctcagtggcaagaccgacctggcccacaacgaccccgctcatgctgcttttctgcgcaccttgcaacttgctgcttctactttcgaagttggctctgctcgtgaccacctgaccctgcaacgccagcgtcaaaaggcgttctacgacaaacatcacaacacagctgatacagatcccttggccgtaaatgatttcgtttttgttcacgacctccgtccccacaacaagctgactcctcgttggactggtccctccatcgtgaccgcgtgtcaccctgagaccagcacgtacactgtcaacgatgttgacggtgagaacccgcggcgtatccaccgcaaccgcctcaaggttttccaccccgcttccatcgttgagttccaggaccgcatgaaggaacatcagtcccgcgagtctgctctccctgccattcctggccgcttttctgcctgttctccacatgttcttcccccggcttcagtggctactcgttccgtccgttctgcagctaccactgcgtcgactagagttacttctcggtcgaagctcgctcgtgttgattctgggcttgctcagggctccttccttgctcagggcctttattcttgattcttctaaccagggcttcgggacgaaaccccgttagacctgggcaggtgtaacactcgctctggagagttagtcatccgacagggtaactctaatctcccaacaccttattaactctgcgtaactgtaactcttcttgccacgtcgatcttactcaattttcctgctcatcatctgctggattgttgtctatcgtctggctctaatacatttattgtttattgcccaaacaactttcattgcacgtaagtgaattgttttataacagcgttcgccaattgctgcgccatcgtcgtccggctgtcctaccgttaggggtagtgtgtctcacactaccgaggttactagagttgggaaagcgatactgcctcggacacaccacctgggtcttacgactgcagagagaatcggcgttacctctctcacaaagcccttcagtaccgccgcctgtcgggaaccgcgttcaggtggaacaggaccacctcccttgcacttcttggtatatcagtataggctgatgtattcatagtggggtttttcataataaatttactaacggcaggcaacattcactcggcttaaacgcaaaacggaccgtcttgatatcttctgacgcattgaccaccgagaaatagtgttagttaccgggtgagttattgttcttctacacaggcgacgcccatcgtctagagttgatgtactaactcagatttcactacctaccctatccctggtacgcacaaagcactttattttctcacatatgcacattcacgtcacctgaacccgaacttttggggccccagtgaaccttgagcaggctatttttggggctcactggggcagacagggcatgtatgtggaatgtgtacaacagcaacggaagaggcattttggggctccttggagatatgtgcatgtagcaggtggtgatacgatactaagccactctgattctttgtggtggttgagttggtatatttgtagtgtacgatacaagtgctagtgcttgcagctcaagatataatgacaaggggagatggtagctattgtagtggtgaatgttcgagtgcaaggtactacagttgctactgttaaaaaaaacagaacattaaccacaagtaaaagacgagcaacgttgattgcacttggtaaacagtgtgtacagtatgtacgatatacgttcgaggagtactctcgtaccactatgtaccgtacatgcgtgcttgtgcaagtattagtcaggaacagttcacaccaagtgtgcgtttgtagacacggatcagcacatattggctaacaatgggctaacaatgggctaacaaagactaacaatggctaaaaatcatcgaaaatcggcaaaaatgacttgctacaagtaggagtgggctcaatggtatgtacatacttgtatgtaccatgtaggctcaaacctacaatgtggagtagaagtcgattacttgtgtagcattggttgtttctagagtataccgaggtcgcaatcgttagcttgtacttgtacttgtaggtactgtagaagtacgaacaagtacagtacatactctacagtatgtttccacctatgaagcactgattaccatcatatcgtttaatacgtacctcaacgacctaccctgccgcccagaaaccctctcaatctgatgataagtccatgggacttgcctccgtcagactcttccatctgatccgcccaccagattacaattccacttttgaaaaaacaccaaaacacactgtctgtttatccaacggtctgagtggagatgcaactatcgtgtagggcaactaactggagccgaaaagtcttcatcttcagagagtgtagaaacacttcattgtcttagactaaagtctccgactccgttccatgacaatgccattccctctggaatgccgttccctgtgagataccattccagcactgtactgaaactacagtacttgaacaaactctatatacacgattacaccttcggctgtcggctattctcaaatctgcaggaacatatgcaccacgagtgagatcgatgacagggtctacctggaccaatattggagatattgcaagtgggaaaattggttttggcatgaaattcattaaggattcgaacagttgctttttcgccttcggaatcgccccgtttggccctgtcaacagcacccccaatcctcatgtctcagctgtataagtcaaaacagttttcggtgaagaaaagacctgaacagagtatcagaaatccaccaacgtttctattcggggtatttgtcctagttactacttctttgcatcagatacaagtacttttgggctctttgcggcagaccccgcgggatttgtgccggtccccacgcttttggtaaattggaacaatataggcgaaggacgtggaatcaaccatacactacgtcaacagacactgaacagggtaaaaagtatcgacttttgactgatgatgctcttgatacatgcctttgaagtcaccgccctcatgtgggtccatttcaggtgttcgaaaatcactgccgtgcccgaaatacaatgtcaaccgattcccattgtatggatgacaagtgtctcagctcaccggctcctcgtgttcaccaatgcaacccgctaacagaaaaagataaacccaacaatatgtgcacgctgcctacaacaacacccgaatccatccagttgagtgtgggccgaatggtgcctggaaaatcgcccccatccggtcaaagataagatcttgacgactgtttagtcaacactcgaatcagaatgtacttcagaatacacattctggagtatccaccgagagccgagtgcacatacacctttacaacggcatggtttcgtttgacctagtccgagtggtccaatgagttgccagatgcccgagaaaaagagaaggttgtttggagcaggattccgggcggaaaccgcagatctggactgataagaagtcgcagatgctgtgttcttcctcggtgacgagccaccagcagtcggctactgttgttcgtgtccctcgtttgaatgtttccgtctgctgtgtttgatcgtttgtcctcactgtgtctctcattcattgtgtcatggatactgaaattacccagaagatatcactttgattgcatcgattggggctgggatgttctcttgtatgtacagtatgtatgagtacatggtggaatctcgtttttggcaacagcgaaaatcaagataaacagcgaaaacagatccaaacatggcaaaaacagaaaagatccaaatcacgaaaccacaccaagacctcaccgtcattcctctggcccacatctacactcatctcccctttcatgtccaggactaggttgagtaacacgatgtttatagactgagctattgtatgaggacatagtcttcccctctacatcaccacaacaactgccggtacctgtatctagttataacagactccccaacaaatagctacaagcccgaccgcacaggctgcccacagtcgcatgtcgctgagtcatcggaagtgacagagttggagagtgcgttttctgcaccattcagggagttttatgcgccgaactgtgcctcggccgagtttgccccgggttaagagaggtgtgttttccagacattcagagataggggagagatgtggtggcagcataaatcgaagtattctacttggctgattcgattcatgtcgtcaaaaatataccgtatctccgaaaaacacgttgttccgggctgctctcctccaataaccgagtcatcccggtcgttgtttcccatctcgtgccctaaccccagccatccacctccccgactttgtcccgactggcctggagcaatgtggagaaactttagtttactctaaaaagctcaaggtcccaccacctcatacattcccgttgtaccaccacatacacacttccttctccccatccccatcacacacacaatgtttgctctgcgaaaccaggttcgaacccacattgcccggggctttgtctccgcccgacagtctctcagcacactggctctcattgagcagagcaatggcaccattgccggatctaccctcaacgccctgactgccgccaaggagctgggaggcgacgtgaccgctctggtggccggctccaaggctgccgacgtggccgctcaggttgccaagatcaagggaattgccgccgtgctcaccgcctcatcccccgcctacgaccacggtctgcccgagaactacgccgatctggtcgctgctgccaccaaggagggtggcttcacccacgtcgtggccccgtcctccgcctttggcaagaacgtgctcccccgagtctccgctctgctcgacgccacccagatctccgacatcaccaagattgagtccgaggacacctttgtgcgacccatctacgctggcaacgccattgagaccgtcaagtccaaggaccccatcaagttgctgaccgtgcgagcctccgccttccccgctgtcgagctcgagggcggctctgccagtgtctctgacgccaaggaccccgcttcggagccccagtccgaatggctgtccgaggagctcaccaagtctgagcgacccgatcttggaggtgccaagaaggttgtgtctggtggccgaggtctcaagaacaaggagaactttgacaagatcatgttccctcttgctgacgcccttggagctgctgttggtgcttctcgagccgccgttgactctggttttgctgacaactctctccaggttggccagaccggaaaggttgttgctcccgagctttacattgccgtcggtatttccggcgccatccagcatcttgctggaatgaaggactccaaggtcattgccgccatcaacaaggacgccgacgcccccatttttgaggttgcggacgttggtcttgttgccgatctctttgacgctgtccccgagctcaccgagaaggtcaaggcttaggaacaagagtcattgaagtgatgcatgactagatcatgaatgatgaacggtagaagtgaatgaataacgatttatgtttgtatgaaaaagaatcttgagcgaatagaatgcctgataagccaatgtctgcatatggtgatgtaagctgcgttccgtgatatctacgatactagcacactgaagctacgctatcatccagatcctgacacagccttgtgtagcatctttgcctattgattgactgtagtggagcattataaactgacctccaaggagcatatgatagcttgtggggcatctacaagtagtgtacgatacgtagctgccattggcattacaacatcggatggaatccaagtaagcaatgcctggtacagcacactgacacaagtggtctttgcacaatgcaattgcaactatatcagctacaatcacttctgattcttgtgattacttctgattccaacttcatcttttcaggctcggccatctggcggtgtgtccctgaatgtccacaatgtttaatgaacagatatcgtaaaaattaaggggtatcgatgcatactgaagaacatgagattatcccagccatggtaaaggtgcgagcatgataccgtgacatcgatgtcgtcttcatatacaagtattgtcacatgacgtgacgtcattgaggttcaagagcactcagaccaccgtcatttgctacctttcattgtacatactgaactggtacatactggatctgtacacacagtaacacgagcgaaacattcttccacaactctacaacaacacactgccagagtattacgagcagaactcgtactcttaccgacgcctacccattgtaccgccccaattgaacctccaaggtatcttggaacccagcagttgtatattatatccttactaatacgttgctttcggtaacagtgctttttaccttgtttgatccaagccacgttcagtctggaatacgacgatagatggtgtcgtgtgtgtgccactagagcagtattccgtatctcgtcgtatcgtatctattgtcgtttccgtatgacatcacatgtgtcatgacactggccatctatttatatccatcccttttccccgctactctctctctctctctctctctctttctctttcttcacgcccatctcctccacacaaactctgtctttgtcctgcctgccaactttattggacagatcttcgtgtacatctttgtcttcgatcgaggacgatgaaagaaaatgaaaaatggcggcgaaaaatagcgaaaaatggcgaaaaatggtgaaaaatggcggcgagaaaacgaaaaaatgcaacaaacaacgttcagactccggcttacgaaatctaggtgactagtcgagagcttaccaaaacgccccctcctataggccacacgtgtgctttggtgctttatctgtgcagcagtcaaacttgtccgtgactgtgctgctcaatcaggtgcacttgtgcactacaagtaggtctcgggggataaaaatactctctttttagactctgaccggaaactatcaccattaatagggtcttttttcaagaaagagtggtacccacggtaagagagtcagcgaggtttagtggtgcatacagcagactaaatggccatctggttatgaaactacaacagaatgtgatggtggttgtggccattgatgatatgggcaccttaccatacaagtcggatcagactcgacaaacgcaccactccctcctgcctctcctatccccgccactaccaccccctacgcacccaaactcaataggtcttgctatcaaacctagagcctggagtcgtacagtgtcgtgcagcataggcgacacgttccttcataaccctcctaaagaacctgacaattgcagcagctaggcgagaaacaaaaagtcgggtgttctttttttcgatcctccttgttctcccttacacacagacgagcccctcgatcacgtgaccacaaagcaagccccaaaaccactccactccactccatccccctaacacactagctccccccacatcatctcatccacagctagcaacatgacgggtgagaatacgccgttgttacacaaagtcaccatttccgagcccggaacgcctccccggccaggaaccccgactctccgacccaacctcatcagacacatctccaacaattcggtcaagccctcgtcctcttctagcaatgacgatgatcaccacagactggttcctccaccaactccaaaggccctacggcccaaaatgaagtcctactgggcttactacatccccgccatggagtggatcccccattacactgcgaccaagttctggggcgacttttgtgccggtgtgtcattggcttctttccagatcccactgtcaatgtcctacgccacttccctggcccaccttccggctgttgcaggtctctacggactagtaatcccgccgctagtgtacgcgatatttggatctgtgccccagatgattgtgggtcctgaagccgccatctctctggtcgtgggccatgccctcaaaccctacctgcaccctgacagtgacaacgtcatcaaacccattgaggccaacggaatcattgccggagctacaggcgccattctgctgtttgccggcctcgtccgattcggttttctcgactccgtgctctccagagcgcttctgagaggcttcatttcggccgttggtatcgtcatgtgcatcgaccagagtcttgggctactcaagctcaacggtctgtttgccgagctgtcgcccaacaacgaaaccaccttttccaagctcgtgttcgtcatcacacactggcatcaggcccataaactgactgctgccatcggtctgtctgccctggtggtactggtgatcctgcgaagtctgaagaagaggctacgagaaaagatctcctggatgcttttcgtgccagagattctcattgtcgttgttgtctgcaccgttctgactgatgtgtttgactgggaccgagaaggagtgcttgttctgggcaaagtcaaacctggaaagctccacctgagattccctctcacccccagcacctggaccgacttcaaggctaccttctcggcatctttcattcttgccgtgcttggattctttgagtctaccattgctgcaaagtcgctgggtaccacctttgacgtcgctgtctccaccaacagagaactggttgctctgggtctgtgcaacttctttggctcgctcttctgcgcccttcctgcctttggaggctacggtcgatccaagatcaatgctctttctggagccacgacccagatgtcgtctgccgtcctggccatcatcaccatgctgtgtacagcctacctgatgccctacttcttctacctgccttcttgtgtgctgtcggctgtcattactgtggttggtctttctctcctggaagaggctcccggtgatattgcattctactggaaggtgggaggctaccaggagctgttcactctgttcctcacgctctccacgaccatcttctggtccgtcgagaccggtattgctgtcggagtgggtctctctgtggttcgagtgatccaccatgccacacgtccccgaatccaaattctggctcgaaagcccggcaccaacgacttcttcaacgccgatcttagtcttgacaacgaagatggtactcattctgagctcgaggatattcacggatgtctgattgtcaagatccccgagcctcttaccttcgccaacacgggagatctccgaacccgactgggtcgtctggagctgtatggttccatgaaggtgcatccctcgcaccctcgaatccgagacgacgacatgacgcagtttgtcattttcgatctcaacggaatgaccgaaatcgacgtcagtgcggcccagattctcatggagattgtgtcccggtacaaggaccgaggcctggaggtgtactttacgcgagtgcccaacgaccacaagatccgacagctgttggacaagtctggtatcagtaagctggtggccgatgataacgccgtttactacaattctatagaggaggctttgcgacatatcgatagtgaggcttaggtgtcgcgtgagtgcgggctaagtttcagtggacacattaaccccaggccgctgggaagagaaaagaagcatttagagtaacaaatattgatatcttaggtcgtagagaaagagtcctagaagtcggaactagagcgatagtcgactttacgaactcgtctaccacgtctgtttactcgtttgaaataggaaggcgatatggcggatatgaatgagctgtttgtctcactggattctatcggtacttgtatcatacagcacgagttgaaagataaggttgcaaggcttgcattatctaaactcaacttgagaggctagttactacgggtacaagcatcgtactaagtatgtagataccgtaaaatgttggtatcacgtaggtgaaacattccaatacaattgatagtcgagtggcgttatattctatacaaattggagctctatctcgattattactcagtcaactgtccaccatacgttcctccgctctttttagggtccagcagaccagactacaagtgcaagtgcttgttgttgcgagttcgacgctagcaaatggagtgaatgagtctattgattcccaataataggtaaactggagtcttcagcttctgtataatcattgatcattgaatcgagaaagtctttgaatttcagtgctccctcccccacacggcacaccatttcacagagaagctcttcatccctcgactgtaatgagaccgagtgttcaggtgtccccttctggttcaatacaactagtgtaaagagctttctggtgtcctccctgtcttctcccgagcagccctaaatcccctacgttcttctacaatcaagtctttttcttttttcacctgtataaacaggggtggtggtccattgaggtctaaacaacacagtggaaatgctttcggcccttagcgatgccgtccttgacaatcttggccacctcctcggggtccttggtcatcttggtgaagttctcgtagccgtccttggtgacgagaatgtcgtcctcgattcgcactccgccaaccttccagtacttgtccagcacggctcggtccagaaacttctcctgctcgggctggatgaagtggtctagtaggtacttgttgaagtagcagccgggctcgacggtcagcaccatgttctcctccagggttcgtcgaagacgcaggtatcggtacatggggtccttgtcctcgtagttgggtcggccggcggtgtcgtgggtgtccataccaagcatgtggccgagtccgtgggggaagaagccgcaggagactcgggagtcaaagatctcgtcctccgttccgttggtgaagataccgagtcgcatcagatgtcgaatgagaattctgtgggcgtctcggtgcagatcctcgtagtttacgccgggtttgatcttctcaatgcagtggttctggatgtccagcacagcctcgtagatgtctcggcactccttggtccactctccggagatggggaagcaacgagtcacgtcagaggcgtagttcttccactcggcaccagcgtcaatcagcaccagcagcttgtcgtcgagaggcaggtcgttcttgacgtagtgcagggtgccagcagaagtaccagcacaacagatgggatcgtaggactggttcttggagccctgtcggatggagtggtagataaactcggcatggatatggccctcgttcttctcaatgggaagagcagacatgacggctagatgcgagttgtcggtgatctcggaggcgtgtcgcatgagagcgagctcgtgtgagtccttaatggctcgagcctcgtccagcgcgtccagcaaaggctgagacatagtcacagcgtctcgcttgtcgtaggtctcgacactgatgagcttcttgcccttgaggtcgctctccaggtggttcatgtacttgatttcgtccacgtcagacacggctcggatctgttcgggagacagcggcaggccggaccacatgacctcctcgtcgtcaatctcgggaatgtaaagagtgatcttgtcgtccttggcggagtaggtgacaatggcgtcgggggcctcgtagcccgtcagatagtaaaagtaccggtgctgtctgagaggcacggtctggtccgaatggggccacagggtggttttggcagcttcaatgtaccacagagcgtcgtcggaagctccggaagctttgaggtgtttcgcggccttgagggcgtgggccttggcggggtattggtcgacggtcatgattgtgtgaagagaggagatgtggagaaagagaggtgttagccgatacttgtatccggatcaaactctaagatttagttgcacgaacggcactggagatgcagttgagcggtggaccaaatgcaggtagaaagggtaggagtaggcgatcggagtccgaccgtatgaataatctgtacgaggagtaggatacgcacactaccgagtccttttgcttagtaatataccttgtcttgtcttgccgcgagcccactgtatataataatggcctacttgtacgagcactgtattttcttgggtgaaatttcacttctgtcatcctgacttggaccggatacaagaagacatgttccgagagagacatcatgtgtatgtatgatggcatgtacgtggagaaagacaactgtggagtacagcaattagtcattcagctgctgtacgtacagtcttgtaggttgtggtatggtgtgactactagttccgatcccgttcctgttgtatcgagacacttctattagggagatgtatgcctctcactttgatgatcttgtattgtatcagaccccattgagaaatcacctgtaacatggccaatggcgaagtgctagtccttggggatatctccatgtctccgttgtatccccttttttttcctccgtgtagatctgtctgctatattatagtcactggactccatgtccagtcagactctgaatgtcctctcgtacactacatactgtacatactccttcgtcagtccatgaagcattgttacgaagaagaaaatgaaaaaaatggcactttcaatatatcaaattgatgggctcgcataggagcttcgatttagctgctttcggcatctttttcactattttttgtctcgtttatctttggtgatcactgcctgttccccgggatggactagtagacacctaaaccggccatttttgacaaaggtgtgatataaatctcgtatgctagttgttgttggtcacgtatacttcctatatatgtcttcttcgccccccattgtcatacaaaaatggtctcttctggaccccttccattcacctctcagctcccataccgcttctactgtaagtacgaatcctcacaaacttgtccagttaccaaatgccacaacactctcctcagtcgcttaataatcgagatacgagcatataactcgaactggtgatataatacgtgaccttactcacccttcgtcgataaatacctcgtaagagcacctgaactgactcccccttcacccaccattcaccatcttgacgcatcctagaaccttaagttcagagcagtcttgaagtgatgggcaacccagccatgagccctttcagtgagtgtcagcaaagtgtgaccggggtttgaacatccgggccatggagatgctgccatgaccacgtacctatatatacctgtatttgtactgtctatgttgtcacactccatacgacactccaattgcctatatgcctacaatctagctcacgcaacgcagtcactgatttgtggcgatataagtacaataaacgtagatcgagcatcaaaataccggccaaaacacctccaaacccacgtcacacacccacaaaccaccttgtcaagtgaatgaccagaatatatctccccggtaccctaaccgccaccctaaccccataccctaatgcagaaggactcgtcccaatcctggccgctcccctaatccaaacccaaagtacaaaaattctgcgcagtgaaaaaaaaattgaaactcacattgagagcttctcctacatatcgacctagcaacactatcgacatgtctgctgttgttcaggaacaaaccgactatctcatcaagcccgagaatgttggcccctcggccgacacctctgagtggccccttttgctcaagaactacgacaagctgcttgtgcggtccggtcactacacccccatccccaccggatgttctcctctgaagcgagacctcaagtcgtacattgcttccggtgtcatcaacctcgacaagccctccaacccctcttcccatgaggttgttgcctggatcaagcgaatcctgcgatgcgagaagaccggtcactctggtactctggatcccaaggttactggatgtctgattgtgtgcatcgaccgagccacccgtctggtcaagtcccagcagggagccggaaaggagtacgtgtgtatcgtgcgactccacgatgctctggaggacgagaaggagatggcccgtggcctcgagaacctcactggagccctgttccagcgacctcctctcatttccgccgtcaagcgacagctgcgagtccgaaccatctacgactccaagctgcttgagtttgacaacgaccgacacctcggtgtcttctgggcctcctgtgaggccggtacctacatgcgaaccctgtgtgtgcatctgggtatgctgctcggtgttggaggccacatgcaggagctgcgacgagtgcgatccggtgctctcgacgagtccgacggaatggtcaccttgcacgacattctcgatgcccagtggctctacgacaacaccaaggacgagtcgtacctgcgacgatgcatccgaccccttgagtctctgctgctcggctacaagcgaattgtagtcaaggactccgccgtcaactccatctgttacggcgccaagctcatgcttcccggtgttctccgatacgaggagggcattgagctggaggacgagattgtgctcatcaccaccaagggtgaggccattgctcttggtattgcccagatgaccaccgtcgaccttgcttcctgcgaccacggtgtcgtgtctcgaatcaagcgatgcatcatggagcgagacacctacccccgacgatggggattgggacccgttgctaccgagaagaagaagctcaaggccgacggtaagctcgacaagtacggtcgacccaacgagagcactcctgccgattggaagaagagctacgtggaccacactgaggacgagcccgtcaccaagcccgttgtcgcttctgtgaccgagaccattgctgtcgaggcccccaagaaggaggtcgaggctgatgtctccatggccgccgactctgacgatgaggaggaggacaagaaggagaagaagaaggaaaagaaggacaagaaggacaagaaggaaaagaaggaaaagaaggagaagaaggagaagaagcgaaaggccgaggactccgacgacgagggcgagaagaagaagaagaagaagaagagcaaggattagtgtctgcatgtaaattatgttattatttggttccgacaaaaaggtgcaaagtggcttggactgaagagtggaagggtagattgtcagtgtgaatactaaagaagagtggcagtagaagatggctaagatttgtatggattctggttctgtattgaagctaggctcatcacgcggtatgaggcctacagagacaagaggtggtatgtggacgaaaaaatcatgttgagaaagttgactgcgagtatgcgtacagttgataatgtgacaccccttgaataccgtctgattgaatacccaactgttaacagaaggcggtttcacggagagcatggcagtgtaaacaacagagaagttatggccaaccaacctgggccaagaagctggtcaaaggcttcttcgttccatccaacttacgtactcagattgaccatctatcgggctacccggatatcgaccccgagtggccccaagctctggatgagcgtggcatttcccttgaccgtcagcctgaagaacttcagccatgtgaaaaacttcaagcgctgtggcgacatggcttccgaccagcgttgtcgctcgaggagcagacccgatggattcgcaacacctgcgtcgcctccctgatcaaacgagacaacgttggtaagtacggaggctacttggtcaactggctcggctgtaacagtaattgtcacccaagctccctctccggaggcatgttcacagcccacttggacgagctcagagcacagggttctagtatcggtacaggtgcgtaccagcaataactactgtatcttcgtgatgttaagatgtctctacgacctgaagatgcgtccacgaccaccacctgaagatgaacctctatttcccactctaaccaacccatcttcttgacctcagttctgtaggagatgtaaagtcgatgaaaaaagttctcataactacactactcgtactcgtaccgtaaagcacaatgtacaaacatccctagtacaccaatgcaaacagccactcgtcgtcaaatcacacatcagcttgcaagaagttgtgtcacaatgctcttctgttgaactcgacagattcgctgaactcgacagattcgttcaactcgacagattctagaatgttccagaacccacatccagaacccacatgcctcgtacaagacgataatccctctgaacacttgacgggccgtcgacgtgattgtacatgtacatgaaaaatgccctccaaacgtcaccgcttatctgcccacgtcgattgcacatttagtttgctaattatgctaaaaagccttcaaaatgtcgtcgacagcacaataccaacttcttcagcagagccgtcagaagccccaaatgaaggcgctcagaagtcccatcagctcaattggacgttaaaagacattctacatgttttcctaccctccaaacctccccctgatccctataaacacctccatgtcctctttacacccgccaaacctcaccaactaaatcatccttagagttgcactaaggctgcagtaatgagttgttcatgcacacgtacaattgtctccatgatcatgctatcatttattaattcttacatgtgaatgctcttgcactctatgtacaataagttagtctattaaaagttgtcctcaatggcctttcgctgggcgtcggtcaacgagctggggaagtccaccttgatggtgatgatcaactgaccacgctcaccaggcttcttggaaatgggcataccatagttggggtaggtgataatgtggccggggttgatgggcagacgctgctcaatcttgagcttcttgccctccagggtctcaatgatcttggtgaatccacacagagcctccttgagagacagcttgatggacattttgagatcatcaccgtctcgagtaaacacggggttgggcttctgctcaatgacaaacaccacatcctgctggccaccgttgggctgagagtctccctcgccagcaaaggtgagcttggtgcctgccttccagccgggcttgatgttgacggtcagcaccttctcttcgggctggccactggggccctttcgggtgatcttcattttcttggtggcaccggtgcacaggtcctccaaagacacgggcatcttgactgtcacctgtgttcgctcgggcgatcgggccctctggcgcggcatgcctcccataccgcccatgccgccacccatgcctcctgcacggcggccagcacgtccgccaaagaggttggcgaatcctccgtagtcgtctccctcgtcgtcgaatccgccctgctgtccgaatgagttgaagatgttgaaggcgtcgccagacgagaaaccaccgaagccacccggaccaccgccaccagaagagaagtggaaagtctgagggccaccaccgcctcctccactagagaagccacctccggggaaacctccggcgccgccgggaaacccgcctccgcccggaaacccgcctccttggccgggttcgggcatgggaactcctccttttcgagcagcctctaaaccatactggtcgtagagctctcgcttctccttgtctgacagaatgtcgtacgcctcggaaatctgcttgaacttctcctcatttcctccgggcttgtcaggatggtacttgagagcagcctttcggtacgcctttttgatgtccgcctcgctggcgccagaagacaccccgaggtcgtcgtagagctttgtttctttcaccatagtatcgcttgtgaaaatgtatgggtgtagtaacctatgtcgtgcgttacaagagcccgcaaaaaaagtgctgaccacccgccttaagtattgctcagagcctattcgcactcgactcttctggagccttcgagattggttgtgaaccttccagcgtcttcgccgcgataaggttggcaattgggaccacgacagagctaaattccaaggcggcagtttggctgtgagtgtgatatatatatacttagcgcaatagaatagctacagaaaaaagagggaaaagtcacgtgacagacaggatgtcggagcgcgcgcacgtagagagaaattcttaccaattgagcgttcccctcgccacccatacctcctcctctcggtgttaaagtgtacgtagcgtagctactgtacttgcaggcgtgtgtgtcaggcagggcaatattaatacatgaaccgcgcaaggcaaaaaaaaaaagacgaaaaaaatccacggaaaaacccgcaaactcagccaatgggtcgctctggccgctaaacagacccaattttcctcaattgacgatctcaaatgagtaccttcgaatttccatatttttcatcagggttagggtagtcctgatttggctgatttctgggggggggaagagagaggtccacctcacgtgaccatagcttaatctcgccgctcccaatatgccgtttagtccgtgatatctcgagcagcacgaaacaggttgaatccatgggttcggaaacaaatcaagcatccgcgcagcctcagcagccaccggcgcagccccagggccaggtccaaccccagcagcaggccgcggcagccgagtcggacatgtctgtgattttgtgctcgtcgagttacgataacaccatcaagttctgggaggcattgagtggaatctgctcgcgaaccatccagcatcctgattcgcaggtcaacagactggcaatcacgccagacaagaggtatctggcagcagcaggaggcaacacagtgcggctgtacgacattcgaagtaacaaccccaaggcggtcatgacctttgagggacacacaggcaacgtgacggcattggcattccagtacgatggcaaatggatggtcacttcgtcggaagatggaacagtcaaggtctgggatatgcggaccgccacagtccagagaaactacaagcatagatgccccgttaacgatgtggtgatccaccccaaccaaggagaaatcatctcgtgcgaccaggagggaaacattcgaatctgggacctcggcgaaaacacatgcactcaccaactgatccccgaagaagacgtgcctgtacgatcagtgtctgtggcgtcggatggatcaatgttggtggccggaaataacaagggcaactgctacgtgtggaaaatgcacaacacccgcgacgtgacttctctgcatcccattaccaaattcagatctcactcaaagtatatcaccaaggtgctgctatctccagacgtcaagcacctggccacctgctccgcagataacacggcccgaatctggtccatcaaaaatgggttctcgttggaaactactctcacaggacaccagcgatgggtgtgggattgcgcattcagtgctgactcggcataccttgtcaccgcaagctcagaccattacgtgcggctgtgggaattggcatctgggcaaatcatcagacaatacagtggccaccacaagggcgcactttcggtcgccctcaatgatgtttagtctactaaccagcttatgtattttattatatatctatgtatatctttcatcttcatgtgctttaatcacacagtaacaggaggagaagacatggggcggtaccaaaactccagtttgcccttgatcatttccacctcaggactcacatccaaaatatggatggactgggggaaagatccgtcagcaagaagcccgtcatgagcaagatattcgtagaggaagccgcacagaacagacatgtcgtggtcaagaccatgcttactgaccacgagattcgcgtcaagctccaaattgtcatggtcctttctcacaagatcgccacagatcatggtctgctcaacgtaggggcttgcaggatgtgtgaagctgagattctcgtgagcagacgaaaaaaaggcgtaggcgagattcacaatggactccaaatcgtcgtccgaaaggaagtcgttctccctggactcagcaatatcaccggcaagaattcgcaggtagttgccgagcataaaaaggctgatggaaacaacggggttgtatgacgacatctgaactctgcagtaccgcaactccaccaacgcctccaatagtgctacggcaatggtggacttcaagtgaggcagtcgctcccaatcggggatctctgcttcgtcttgaagttgatgtaggtttctcagcgtcaccaaaaaggtcatgatatgagaatcaataggtagaacttgtgcctgaaccatcaatcgaagacatagttgcatggtaagcaacttggattgggtcacttcttcgacaactgtcagacacttttccgtcttagcattaccctcaagagtgcaaacgtgagcaagaaccatgcccaggacctttttgaagttggcgttatcaaaatactccaccgaatgggtcatcaatgtcaacatggcctggatgacgtctccagacaccttgttctcacattcgcagacaagcaaacgtgccgaaggcaagagatcgacggagttccgcacagaaatggcctcggtgacaccatccatcaggtgcctgagacattgatccaaagtaggaggattcagcaatgtgaacggatctctgttgactccagtcccgcactgggtgcacacgacgtgactgtaagggtactccagctcctgcgacacacaacctgggcactcgcaccagaagcggaaatgcatatacaacagagtacgccgttccggggtagggtgcatgaaccgggtgtacgataggaacacttcgtcgccgtcgttaataggtttccagcacacgagatgtacctttctgcctctaaagagcaagtacgcgttgggaacacagctgtggttgatcagagcaagagtaggatcgaagatgtaccctccctgtcgccctagatcgtcacatcgagtgtattggttgacgaagagcatacctgcgtactcaagaatctgttcaagcgggtgaccgcgagaggcgtttctggagaccagagcttcagctgccattcgaagggtatccatggcaggccaggaggtatcggtggtgtggtgggtgagctgggcgtaagtgttgcgaggacggggctgctctgccatgcataaaatccggtacagagcacgtaggaatccggacatgatcagtttttggggcccacagagatctgtacattcgggagaatgcaaggtgtccgcttcgagacacctctgcgagcaataggacatgagcttgcagtcctgacaaatggtgatgtttctggcggggtatgtttcaagacaaaaggcacaaacgcctgtagtggggtcgagacgtgcctcctgctccacctcgatagttccgtctgcgtctccacctaccagaagtcgtccggagagagggacgttgacggcaggttcaaacgagcaaatgacatctcctgtggagtaataagagcacgacacaagccctcgtttggcgggtccttccccagccttgaagatttttagaggtgccattgggcacagggctaccaacgttggtgtttgattgggttgtgtgtgttatgtggtatcgggtggtatctgtgtagtatccggggggtatccgaatggtatctaggtggtatcagcgaagggtgtcggaaatgatgcggttccgaagggtatggtgcagtttgtgtggttaggtatcagaagactatgatatgagtctgtggcccgtgtaaggtgtccagagtgcggggaggagacacaaacacaaggtcacgataaggcgcactacttgtagcttcaactagaagatcacgtgtatcgttggtgtgtgtgtgtgttagctacttaggtacaagtagtgtccaggtgagtgttgagcaagtgtagaagagtggttgagaggtggtggagacagagtggcctgtaaacaagatatcatggggcctattacagtctgttgctaggatacggtggaaaaatactcactgtgctacccgagctcacaacaatggtattatctgggcgtgaggggggcgaagggcgtaaatatatatataaaaaaacactccgaaacaagtagcaccgacaccgacagcatggaccaatggctactcggcacacactgtagctgctcaatctgttgagtgagtgagatgtatgaaagagattcatgatctgataagctacagatttctggtgcaagtacctactgtacaaaaaagtgcacacttcaaacctgttctcaaacgctcaatacagtcgatatttgcactgtagaaactactgcttttacttacccacaatggtagattttctattttcttctttgtttttttccgagtttttcgcaccattgccgctagccaattaattgccctgtatcggcagtcagatggtgcatacacactgtacaacaatgggattgtgaatgattagcttccacggcgctaatgacggaaccggaaaggaggttaggcaaatagggggttatagcatcggctctgtggagcaaggcttcgtcggccaaatcgcgggacttgaccatcgtcagcgacaatggtggaatgggttggggttggactcgtttagggtctttctccccactttgaactggtacgagaacggtacatacggtaccagtatccgcttacagcagtatcgttcaatacactccagattcgacgcaaagagcccgaattcgtcaagtcacatgtcgcacacggcatcctgcagctggccacagactccagagatatgttggacctccaaacagctagttgctgtccacgttatacggcctatagactaccagcactagtacagactgtactggagccggacttaacagtgtcccaaggtccaagactgatacaaatggcgccggtcgtgtgtggaccccccccaattggcgtttcaggtcgcaattgctctccaaccagactcagaccttcgcagagggccggatctgagttccgtgactatttcgtaccagattcaaaacgagaaatcaaactcagcccaccatatcacccttcagacaaccatttttaaccacggcctcgaaataagcaaaactctctcccaccgtaccgtaagagcagagggcgtgcacagcactatttttggacttgctcaatctgctttcaacctaccctgtctggctataactgccctcagacagagaagatacccgcctcagcctcccgcagggtcgggtcagttgacagcctgactgacgcaggtgggtcatcgcagcgacagacccgacagatgcggtatctgctgctgctgtggccgcccaacaactccatctccaaaatccaccacagcccacgtcattctattcctggctcgggtccgccaacgtgcattttcagaaatcaattaacatcggacgcattattaaaatttagacttttccaagacctgctcgctaactgcagctctatttttagacgccgagcacccagccacgcgccaagagccgagcgacacacgtttgtggcgatattacgagattaacgtgtatgtgagatttccaggcgattacgcgccgctctcagtggtaccggacggccccaaacacgccccggaactgctccatatccttctcctagcgttggttcgtgaccaagcatgattttcagttgccaaattaggctacatgcatgtatcaggtcgctatttgtgaccgactaattagggggcccactgccatgtgtacagtgcaataaaaggggtgtttgcggcttgggaaccggggaaaataccatgggatcggcctcaatcggtccaactcgccgaggagccgaaacccgcgcccgaaatagcgccctctacgccctcaaacttccagattaccttctccatcaactcttttttctcacctcacacaacgcttccccgcatgcatgtctaattatgcaatatgcacgagcaccaggtaatgggccacgacttgtggtgccccccccactatgccgagtatataataaggcggccatcccagcttgcagctctcagacacctttgtagtactctttcaccccccccaaaaagaagaagacccaagacaaaatcaaaccatgaagttcgcccgaatcgccctcgtttctctcgccgctctggccgctgcccaggacaacaagaaggccgatggccagaaccccatctcgtctcccggtgccaacaccaagatttctcccggtgagaacttctacatcacctgggtggccgaccccgccatccaggccatcaccctgtctctggtgaaggacggacagaaggttcttgatatcgctcccggacaggccaacgacggaaagttcacctggcccgtcccctacgaccttgaggccggctccgactactccatcgagatcaccaccttcaacggcgacaacgtcaactactcccccaacttcaccatcaccgaccgagacgagtcgctgcagaaccagatccagaaccccaacgcccacggtctggtcgcctccgagtctggaggaaccgaggctgccgcttctgcctacacctggtccgacgaggtcaacaccaagactgccggtgtctttgcttccaccactggatctgcttcaggctctgctgcctctggctccgcctccggctctggctccgctactggctccaactctggctccgctactggctctgctactggctccgagtccggttctgcttccgccacctctgctgctgatgcttccagctccgcttctgcatctggttctgacgcctccggctcggcttctggctcggcaactcaggattctgatgcctcttctacgggcgatgcttctggatccgcctctgccactggctctgcttccggctctgccactggctctgcttccggctctgcttctgacggcgcttcttccggctcgaacggctcttctgcctccggatctggctccaacggttctggatctgcctctgccactgcttccggctccggttccaacggctcctcttctctggctgcctctgccacttctgctgccgcctcttcttctccttccgccacttcttctcagaaccagaacggagccggttctctccagggctccatcgctctcgttcttgctgccggtgttgccgctcagcttctttaagcgtagtcgagtattcatggtaccccggcttttgtaatttatttaggactgtagtaatttaatttttgacatatgaccatggacgtatatcgtagtaatcaggagggagttgcggacttgtgtcacattgaatacgagccattgagtaatacaaatgtcagatatgggtgttactgtataatggatgtctttctagcccgcctgtctcagtcgaccatgtgagaccagtacatactgtactcgtactcgtactcgtacttgtagctaaaagtatcaataatgagccaatcacgcaaagttatactactacttgtagctcggatgtatcgagagttggtgacaactgaagatccttcaagtaggttcaactaattagctaacgagagttgactgttcaagtaggatttcaagaatgagtacttttaagatcaacaatttgttaaggacaatagggcaccgtttagggtgcttgtacaagtacgatattggcgatagaaatggatccagtagctcatgttgtggaatcggtttatgggaagggccattttccactcgaaaactcacagaatatcccccatgacgtctcatttctttgacgaatgagacgtcagggagtcgtcgatgaagggctatatatagaagtgtgaattgagtgtccaaacttagcagcagagaaaagagcagcccatctccgatagacgacgattggtcaccacatctacaagtgcttgtagctcatcagcagtgccacttttgcacttcccacgctcaactcgtacgtacgtacagtacatctagactcgcatctccgccacttctcgcactgatccgatccgtctcagagccagtgtctctcgtacaagcaccttgtcaacgcctcctccacgggatctacgggattttcgctcgtcgacagtgagacacgattgacgctgctcagatcaccacagtgatgaaacaaggcgtcagatggctgtacaccatgtccttcagtggctgccatctgaataatgatgacatcagcacttgtttgcaccgttacccctaaataatagtttcatccgtcgtgtctcaagcagctacggcgctctctctctcttccttgtccatgtgtcaccggtgaaaacaagacgctgattggcaccaactgaaacccgagacacacaagatacgaggccagacaaaaagtcacatgaccgatcggacgccgccgagcagcccgcggcgcagccacctcgctctttccaaatactaataccgcacgcaccaagcagcccctgtccctggcctttacggtttcagggagccttgcagatcactgtggttgcaatggaagcaagacggagctcttggtttggttttggatccaaataagattgcaaacagatattatggacggcgcaaatattattgtagaagcgccctaaacgcaacgtctgccaaactacgctctgaacatggaaaccaggtctccaagcccggttggtctctttgcttgcagacaaccccctcatacaaatgtctcggttaattatacttctcacgtgctaatccaataagagaagcctaaaaacggcacacgtcctcttttttttttaaagtattagattagagtttgacaaaccgcatgtaccatattatgtttagcataactccaaacctaccactagcacaaacgtcatacaagccccacgacaaataatggagggcaaaaaacagctcttttcctcggacaaaacactcaatcaaccaccacgcagcccacacaggccctcagatgaccccctctaagtctaagacccccctgagtcagacgagacatatttttcaaaataaagttcatgcgataacggttatctgaaccttgccaagtatagaacagcaaactaccaaggaagagaagacgattgactacgattcttagtcacccggtgtgacctcatactacgctgcagcggctccatccacctaataatttatctatgcatccttgtgggtgggcttgagcaaccccacagtcatgtcgagaaacttggcggggttgccatggggcgtcccttccttgttctcatgcttgttgacctccttgttgtggtcggcagacagaaacgtgccctgttcggccgtccatcccatccattcatccacccagcaccgaaccaccatccacgctccaaacccgtctcctccgttgagaaaaatctcccgtagtgcggctgtaaacacagcgttcatgtaaagcagaaacatatgggggtacacgttggtgaaccgcgacggaagagtcatcaggtacattgcccagtgctccactatagccgacgccaccggatccttgtagtccagcagctgcggaaggtcgacgtcgagaatcttggtcacctcctgtgatgagcacggaacgtctcgagccactatcagcccgctgtccacgtacttgatccaatcgtttttcatcaccgctcggtcgtggtcggacgccagcagcttgccggcgttgagagccagctccgacacccgcaccagccgcatcagcagtgatgcaaacgcccgcgcgggcttgagcttggtctccacaaaccccggcgacgtcttgcacaaagacgacttgaggtactcgggcaagtattgcgacaagctcttgagacccgacaggacctgtggaggaatctcctgcagcgccaaaggcgacagcatctggaccatgtccttgtacataatccagtcggccttggccacccacggctgcagcgactcatgtcgatacagcttttgaactgtggatgtcaggcccccaatgaaagctccatgaatgtggagaaattttctgatatgcatgaaccgtagcgattcgaccagcgactggcagtgggccttgtagagcgccgctagcgtgttggcggtgtcgctgtcagtgcccagaggaaggtacggctccatcgagggcagcatgagggagtcgtagccttctgatagtgacacttccgttaggttcgacacgaaacgaaggtcgggtacgcctggttggggggttcccattatgtgttgctgttgctgttgctgttgctgttgctgttgctgttgttgttgttgttgttgctgttgctgctgctgttgttgatgttgttgatgttgctgctgctgctgttgctgttgatgatgctgttggtgattttgttgcagatgctgctgctgatgattttggatatgctgctgtggcgtgccgggctgggacgccatcatggagttgaggcccagcgcgtagtcgggagtctcagtcttgccacggaacccgtagggcgagtcgaagggagtcaattcgggggtgaaggcccgatcaggcgatccaggcccgggggtagagatctcctcggcctcgccggtgagccggatgccgcagtaatggtacttgctctggccacgaactcccagtcgtcgcgtggtcaggtcggggtagatgacgcgcacgagcttgccaaacgatgccgggttcatgggccgcacattgtgttgcgaacacatggtcacgtagcgggcgtagatgcgggatcgcaggaccgacgactgctcattgagctcgcagaacttcatgagccaggccatgccaaaggtctgcttggtgcgctcgttgccatggcctctgccggcgggcgagtcctgtcgacgcagggtttccacaatatcttcaattggcaggcccaccagttgctctgcggctctgcgcagctctgcgtcgatttcctccgacgacgccattggtgccttgcgttttcgcgacgccgacgagcccgggcccggcgactcgggaggccgcatgtctgtgttattgggcgccggggtcacgttgttggcggctgtgttttgcttgtttgtgtacacctgggagtccatcatcgaggccgaggttgcggcggtcgacgccgacgctgccgacgaagtggacacgttggaatgctcgctttcgttgttggtgagagcgtcggccagcgagtcgtcgttgcgcatgtggtacatttgtgtcaaaaggtccgactccggtttttcgagcagctcggcagacgagcttcgccgagcgcatttccggcgcccattgtggcttccatccatggccacctccattaggtgagtgctagttgggtgtcggggttgacagagtcgtatagatcggagagagttgggtgggtaggatgcaaactgagtccaggagaaaactgcggtctgacgacagggtcaaaacgggtagtgagagtgggggaggttgtggcgacgtttggttggcgctgttttcgacacgtctgtgcttcttttcctttttttttctcctcttttttctcgtttttttcggtccccgtccctcgttttccagctgcttgtggaccgaccgtgtctgtgcggagctcagtaccaatgccagatgcacagattcacactgctcaacattacactctatctttttgaattttcccattttaccttcatcaaactcccacacaataagattgtacggtggacataagattatatcgacctgcaattttagtgcggactcagcagcgaacaagagagacggcgcaaaagaaatacacaaagctacaggtccacagaggctacaaaagcaagctgaaagacgacggcggtttgggtgacgtggcagtaaaccacacggttgtccggccccagtatcgccacccctcccgcgtcgcctaccgcccgctgcccgctgcccgccgcctgccgtcactggtctcgtacaagccacccgtttctcgcccaaccaccaacaagtacaagtactgtactactaccaaactcgcaaactctctccacttgtatcgtgcaagctgcactctgcacagggtgcgtgacaccaactttttcacacccaaggtgctggaccgtccattgatcggatctaggacgcgatctatgggacaggaggtttccagggggctgatctagattgagccatggcgacccagacccacagacactaaatggctgctgctttgggatgttatgtgggacgccccgtgcgtgcagcagagtcaacgatatgccatgctggagcgtacatttgtgaccatggtccctggtggtggacggactgtgtggtgtgattgaggtggtgcaaaatggtgtgtggatgtgtcagcagttgatgggcttcgtttccaagggtggctgactcagagtccagaactctacgtcgatgctctctgtcagcataccaaccattcgatccatcttcagttgtcagctgttggcactgcgccatgaccccgtcacaatggcactcactcaatgcaatggcatgtcgccttcgctctggctttttcgctgccacctcacagttagccttcactgaaccaataacctaacctaaaccaacttgcacaaggtcaccgcgactagggcgctgacaacttggctggtccgtttggggaggcgaaaaagcaaaagtggcgacgtggcctgctgtggatcttcggcgacaaagcagcagcccgccatgatccacagcccgcctcaatccgcagcccaccgtgatccgccgccctttttcgcggttgtcatggtcgcccttttcgttttcgggctcgcaaaaacgtcccccctggttcgtccaaatttaaactgccaatgtttcacaaaaggacagaggtggatgtggcctggtctcggccggtgtctcgtatgcccaccgtcacgtgtcgcagggtgctgtcggggtgaaaaaccaatggaaagaaacgccgattcaatcggggccaaacaacaaaaagacatgacacgcgtgctccacgtaggcaccagggcccgctacgaatgcacttcttcacctacgactgagggttcaccgattgtacaagtacatccaaatggacttgttgccgggggttttttatgcaattttggcagtgcatcagacccttagcgacggttgacagtctgatgtactaataccggttcatacaccaccgcgttagtgccgaaaaaaagtaaagaacactactgtatgtactggtagctactacaagtagtcgacttgaacaccgtcactaccggtactggacatacggtactagtccacatgtacaattccttttgtcgtatcgggtgtcttgtaacggtacctaccgtcttccgtccagtgggcccgtgcaacagctgcttctgactgtctgtacctgacagcgccaaactcctgctacacagttgacacaggtaccgcaacccaatgtgtgagagccatctaattacacctacttgtaggggccatccccacatttgttgctctctctctcttcacaggtctgagacagggtgggcattaacagtgacgttatcccacattgttgccgttcttagtgtctttaggctcttgctcaacgttgttcaacagcctgatgcaaagctagactgtcccaagcttggatactacagccttgctacaacgccaggtatttttagccccgagtgtacgtcacttttgagcgatatctgcgtctgctcggggccaaagagctcgacttgggtgcatcaacatggacgagaatgtcttgcgagagatccacaaccgcccacggtgtccgaggtcgcccccttgcacctgacgactcgcctccagacccatttcaccccgtcttctgattgactctcgtgtctcagcccacctttaaagtggccgaggaaaaaagcagtctgtctctggttttggaggggtgcatgcaactttggtgtgacagatggaacgccgagagatatgccgtggttgaaggaattgctatttggcgcgaaggaattgccacttgatgtgcttgtatcgtgcttgtattgtacgagtacagccgtggttgaggaattgttacttggtgtgcttgtattgtactcgtaccgctgcccgaaccgctgcccgaaccgctgcccgaaccgctgcccgaaccgctgcccgaaccactcaacaaacgatacattccgtacgacctcgcgtacattttcacagcagatttattgcactctaatgagggtttctagatgccgtacgggctcaaacggtccgcaaatggccgctcagagtggctctttgagatagcgacagatatggcgtttacggaaacggacgtacatctgtgaggggaagatggaaaactggggggcatcttccaaacaattcaatagcggtgcggtgttctagaccagctacctaccaacggcataaaccgatattatcataacactagttgtatctatacattacggaagtcggagccgcgtctttctgttttcgcaagattctccgtgacaataaacctcgtacaatatacgacgtatagccatggttctactgcaacaatgtgccactaacttgtctgaaaaatacccgctccatcatagacaaagacagtgtacgatgccagactccactttgacaccattctgacactggcactgacggcccacatctctccagaacgtatagcttaggaggtacaggcttgccagagtccggaatgtgattggagattagagattggagattggagattggagatgggagattggagactgaaggtgagtgaaggtgattggaagtccagtatgaattgaacagtacaatgcacacaatgtgggaaacaactattgcaccaatccacactaacttcaactaaaaccgaacatccagagcccgcaacttgtggtgccatggaggtatatgtctgcaacagtcgcttgctgttggtataatgagttccaaaccatgctttctccacgtacgctctctccacgctctctccacgctctctccacgctctctccacgctctctccacgtacgctctctccacatacgctcagcttcaagaggaaatcatacaactgcctgcctcgcagtctatggatcaagtagttgaacggataagtatcgtagaaacagccggaaagatgcagatgggttttcagaaacacacatgaccggtagactcccttaagacacagacagtaatatccggcatctatccttcatctcgtctatgatacatcctcttctctccattttctccaggttaattacacataaattattctcactaagaatcgaaccgacgtctgccaaactctcccaacccccactccttcatcccaaccctaacaccccgttggtcccaactcccaaaagacagtcacatcacgtgaccgctcactgctcctcccaacctcccaacgtccttcctatactaaattttcacactgatcttctttcagctcatcaacacatctaaaatgcctgccggaaccgtgcccaccaaggatgacgttctcgttcccgagactctcctgaagaagcgaaagaacgccgaccagatccgagccgccaaggaggctgctgctgccgagaagaaggccgctaacgccgagaaggacaaggtcatcttctcccgagccgagaagtacgtcaaggagtaccgagaggccgagcgagagcagatccgactccgacgagaggccaagctcaacggcaccttctacgtccccgccgagcccaagctcgtgttcgttatccgaatcaagggtatctccaagatggcccccaagccccgaaaggtcctgcagctcctgcgactccaccagatcaacaacggtgtctttgtgcgaatcaccaaggctaccgccgagcttctgcgaatcgtcgagccctacattgccttcggttaccccaacctggcctccgttcgacagctcgtctacaagcgaggatacggtaaggtcaacaagcagcgaatccctctttccgacaacgccatcattgaggaggctctcggcaagtacggcatcatctgcatggaggatctgatccacgagatctacactgttggccctgccttcaagcaggcttccaacttcctgtggcccttcaagctctccaacccctccggcggctggggtgtccgacgaaagttcaagcactacatcgagggtggctctaccggtaaccgggaggagaacatcaacgctctcatcaaggcccagaactaagtctgtcttttgacgcaaaaataaaataaaattattcattgaacggaccacagactttcatcagtcgccgtgtctcagtaaattaatgtagcttgtatgtacaagtaataaagtgcaatacaagaaatctaaccgtttattccaaagagtggacccttgtctgagcgataatggttgattgtagctgtagacgtacgacaagacgcaagatatcgacaatctacactgcttcctgctctaatgatggaagacctatcacatctttacccgttcatccttcagctctgatggagttttgcttcagaaatcgggcattataccagtggtataggaacgtgttagcaagagcaaggggaccaaatcaaatacctccatttcagtgatacctcacctattgcgagagttgtttgctcctaatctgaagttgataccatcatatagttgaatacatttgatcttgtaggaatattgatacgagacaggagtgaaaggagtaggtgggttcatgaaaggatcgttataagggggtttaaaacttgaaaaggttctctaggttgtatgaaaaagtcgactctgggatggttcatgagcgagataagttgataagaatgattcaaatgcttgatttgatggaaaagtgggtattgcaaagcacttggcatagtcagtgacgacataggatgtcttgcttaggtccgcatcgtatttttcattattttaattatttttcattttttgctcaaggctctatcgggttctcacaagagctacaatacctgcctaaggggtataaaaatgaagggaaaaataataaaaaatagtagaaaacaaccaaacaatggctacttcttcattggacgcgctcatcgcttcctctatcattctcgcctgaattctcacattgtcaagagttcctcacacacacaaaacatcactgacacaagcaatggactacatacataattctggttcgaaaatgaccacagggacccagataacatatatgtccactttccaaagctctttattacaaattcagttcttattttgtctctaaaatccttgtaagatcggtttatatcccggcaaagttggagtttctcgaatttacccttggttttttttttttttttttttttttccgattttttttccgcctttttttaatctcaattttcgaacaagtttaattcggcagaaatcccaaaagttggtttgacttttagaaaattgagaagaaaatttttgagaaaatgatgagaggaaaacgaaaaatctgaggaaaatatatattaaaaattagtaagcaaaaaatgtatacacctcagaacaatacacagatgagaaacagacgaagaatatattgtagagagtgtacacagtagcaaattattgacctctaatacttgtagtgtgtctttcactatctttagttcgtctttacaaagaatcaatacagcccctttgatcttgtttacttagactttcaactgtacttcaagtaacatagctggagtgtatagaagcaaaagaaacagattacaagtatatagcaaaataacggccttgtaatttacagcaatagaaccaaatcaatccaggattaaaaatattctcgctacactcacacttttagtccaagtctacacacatgacctccatctacaacttcaagtatcaagatgcacatgcacaacaccaaactttagaagatcttgaggtgcacagtttcagcacgataccacactaccacagacacatctcagtattttcacacgacaaccatggccacagcgtcgccatatccatccgacatcatcatgtccaagccgtatctcagcgaaaacgccatccagcagatccaggctcattccgtctacaccacctattctcggtacatggcccaggccaacatcgcattcaaagtgcttgaggcgacatgcaagagcctgctgctgcccgtgcgctcgttcggaacggccatggtactcttttcgcgctactgtctgctcaacaactcgttggacggcactttcgaggaggtcctcattgcctgtcttgtttgcgcctgcaaaatcgaagataccgccaaacgggtgcgagatgtgcatggcgccgtatacttgtactcaaaggtggccatggtggcctttgatgcgtgcaaacccaagatcatgacgctagagcttcagattctggagacggtcacctttgacttccgaatcagacacccccaaccatacatcatcaagatcgccaaggcgctgggagcctccaaggagatagcgcgcctcgcatggaccatttccatggacacatacagaacacacatgcatatgaagcgtcctccacacactatcgcactgtcgtgtttgatactggctggcaagctgaagaacgagacaaacatcttccccatcaagtcggaaccatataactcggatcgtttgtcggtgaatcatgcgcttttggacctcttggatctctacatgatctacctggacagcaccaagctgggcgaacacaagtacgaaaagagcgtgttttcacaactacgaattgccgtgtcaaaggaggtggaaaactcacatgtggaggaacatacgctgagtcacgaacaagaacaagccatttcaaagcaacttattcgggacaaaactcgttctgataagggaaccgttcggtatattcttgattgggaaattcatcagctaggaaagtatgaggaggttaattagcatgccggtatgtacgattgtaatcacattggtcgatattacctgtaggtgtacgtgcagatctctctttgaatcaatatcggtctactgtacttgaaagtcattcatttcatgcattagatcttacaacaccgtcctggtttcagtgagctgaaaccaccaccttctcccagtcttcatattggccctttctaagggcatccttctccttgaggtcaccaatgtgtttggtaagagttctaccaacagcttcgggtattctctgtttcttgagctcataaagcatgatggtgtaaaagacaatccaataaatgcaatgacggcagtctttctcatcctcgtacaactccgcaatttctttgatggtggactccactacttcaatgtggtattcggtagaaatatcaggatagatgatttcaggcttggtcaacaaccatcgtaagtagagccaaacagactggtcgttggggtccataaagatagcattcttcacgtagtccaattccgagccgaaaaacgtcttgggatcactgagacgttttaccagcttctcgtctgtgcactttccctggcgtgtttcctccatgagttctggaatgacctttgatctctgatgccaggcggaaaagtttgagaagttcttgttgatcttttcctcggtgaattcaaactctttgggcttgacagcgcctctgtgggcctcagggagcgtctcctcgtacttggccagcacatatcgtctgtagttccatgcgtggaagtttcgttcgtctttggcaagagcataagttaccatggccagttcctttttccaatccggctttgcggcagtttccaaacaccattttcgatggttccacagccagtaggtcttggggaaccgcatcaaacattcctgaacaaacttgagctctccatccagaaagtcgtctttgtcctccagattgggcaagattccggtcttcagtatttctcgtcggtaattccacattgtgtaaaactcggggttgatcttaatcagcttggtattgagatccagcgcctccttgtcgtgttttccttctcggcgaaactggttcacctgtgtcgagaggccattgtaggcgttgatcttgcccttttctagctgctttttttctgccaactgctcggccgagtatttctgcttgcgcacgttatgctgggttagtggaaatcgggtggcaacagcggactcgagacacttaccatggtgttgtggtggagatagggacgattaggtgttactaattagagagagcgtgcattgaatgcgcttaataagcggagtggagtaatctgaagactagagccaaagtcgacgaataaacaccaagaacgactgaaatttggaaatgaggcttctggagcctacatttacattgggtcgaaatctgggacctattcagcactcctaatcagctattttgtatcacctcttttcgaatggcttatgtaattaatcttatacttactctctacccaatattaaccttgctggacatcccgattgggaggtggatatacaaaccgaaaaccgaatcagtgctactcgacacttgaaacaactcgaaaagtcggttcagacacacgcgaaaatgaataaggcgccgacaagagacagattatcgatccgaggatcgtccaagacggtggcggagttctttgagtactccatcaacacaattctgtaccagcggggcatctacccggcggacgacttccagcaggtcaaaaagtacggtatcaatgtgctggtgacggtggactcagaggtcaaggcatacattcgcaagatcatgggccaattacacaaatggctggtgggtggcaagatccagaaactgattgtggccatcacatccaaagagtctggagaagtggtggaacgatggcaatttgacattcacatttcgggcaaggacacagacacggcttcaaaagaaaccgacacaaagaccaacggcgacaaaaagtcagacgaccagatccagcaggagatccaggcaatcatgcgccagatcaccgcctccgtgtcgtttctgcctgtcttggaagatgaatgcaccttcaacgtgctggtgtatgccgaacaggacgcccctgtgccccccgagtgggccgacagtgccaacagagagattaagaacccggaacaggttcagctccgaagcttctccactaatgagcacaagattgatactcttgttgcctataagctggacagatgaaaccactgacaagtttcccacaaccaacacatccccaagaggacaccttatcaaatctctctcaagttcatgatgatgaccgttaatgaatgataagggccacttgagccgtgtcagtaccaatgccacttccatggtacacacaaatgcataccctttttccataggaatatatctaacgtcatagaaccgtcaaacaaagactcgcacatggagatgaacaagtacatacaggtctgtcctcggcaattacagcgatatttgtaagcacattcgctcgcttagacggtatctcacagatcacacctctgagacacgcctcacttgtagtacatcactacaaactcacgtatacactagattacctttattaggaagcaataattaaatactctacattgaaactctcatagttccgaaaccttttaaagctcatcgtggaaaggagcctcatcatcatcagcgtagaatccaccgtcgttggactcgtctccaccttctccaccctcgtagatcttggaggtgatggggtaggcaatggcagacagagcctccttcttctcctcaaagtcctccttggtggcagacacggagttggcctccagccactcgagagtctcggtgacagcgtcgttgagagcctccttgtcgtcggcagaaatcttgccaccgagaccagacttgtcagcaacctggtttcggagagagtgggcgtagttctcgagagagttcttagcctcaatggtctctcggatgagagcatcctcctcggcaaatcgctcagcctcctcaaccattcgctcaatctcgtccttggagagacggcccttgtcgttggtgatggtaatggtctcggacttgccggtgcccttatcgtgggcggtgactcgcagaattccgttagcgtcaagctcgaaggtgacctcaatctgggggacacctcggggagcagggggaatacccttgagctcgaacttaccaagcaggttgttgtccttggacatggttcgctctccctcaaagacctgaatcagcacggtagactggttgtcaacagcggtggagaaaatctgggacttcttggtggggatgttggtgtttcggttgatgagcttggtcatgacaccaccagtggtctcaataccaagagtcagggggttaacatcgagcaggacaatgtcctcaacaccgtcctcgccggaaagaacaccagcctggacagcagctccgtaagcaacagcctcatcggggttgatacccttggaggccttcttgccgtcaaagaacttctccagcagctcctggaccttggggattcgggtggaaccaccaacaagaacaatgtcgtggacatcctccttcttgacgccagagtccttgagaacctgctcaacgggcttgagggttcgcttgaacagatcaatgttgagctcctcgaacttggctcgggtcagggtctccgagaagtcctctccatcgaagaaggactcaatctcgattcgagtggacatctgggaagacagagttcgcttggccttctcaacctctcgtttgagcttaccaatggtcttagcgttcttggtaatgtcgacgtcgtgcttcttgttgtactgcttgacaaagtgcttgatgactcggtagtcgaaatcctcaccaccaagatgggtgtcaccagcagtggcaagaacctcaaagacaccagactcgatagacagaagagaaacatcgaaggttcctccaccaagatcgtagacaacaatctgcttctcgtcatcggtgtggtccaggccgtaggcaatggcggcagcggtgggctcgttaacaattcgcagaacgttgagaccagcaatgataccggcatccttggtggcctgtcgctgggcatcgttgaagtaggcagggacggtgacgacagcgtgggtgaccttcttgccaaggtagtcctgggcaatgtccttcatcttggtaagaatcatggcggagatctcctcgggggtgtaggtcttcttctcgcccttggtctcgacaacaacaacgggcttgccgtccttgttcttgaccttgtaggggaagtgcttgatgtctcgctggacggactcgtccttgtacttaagaccaatgagtcgcttaatgtcgaaaatggtgttgaaagggttgttggcagcctggttcttggcagcgtctccaacgagtcgctcgtcctcggtgaaggccacgtaggagggggtgattcgagaaccctggtcgttggccagaatctcgactcggccacccttcatgacaccaacacaggagtaggtggtacccagatcgataccaatgacggtgccataagagtccacgtcatcagcctgaacgccggccttggaaaggaaaggcagaaggcataccaggagggcgtaaaaaacgacgccccacgaaggcatagagaacttcatatttcgaggtggttgtgtgttttgtacggttttgtggtaaaaacggcacaggtctgtcgaaagatgcagaaaagtgaagcgggggggactagccttctatataaactcgagtcggatcaaggttagtcattacgtgtcttcaaaaattaggtgggtgcgtggcagggttctgaggccgggtaacccacctgaactgaagtagaaaggcgggggaagtttatctggccggtctcaggtggcgggtttggaggtgttcgcgagcgtccacgtgacctccgagcccacacctacgcgtcacacgctgctaccagccatatcccggctttccccgtctcaatctccccggccatcatgcttctaccgccttccacccaactcttgtgctgctcttctctccactcggttacgtgtccaaacctaaagatgcatttggcgtgcttcacagcagtggcaggcatcgacaggcatgaacagacattccctacacggagtgaacagggtcgttttgggcaagctgccagggtggcagtttgaggtggcgacggtggcaacattgacggcgagtcatgtgagcaattgcgggattgcgggttgctgtggaaccgctcaatgacgtgttaacagcgtctgtgttatgtgtggatgaaatgtgtggtttctaccatattccacatgacacaggccagttaaccgttgtgtgatttgccacatgggacagaacggggtcttgggcgtgttacacagacacagtcagaacaaccagacccaaccagacccaaatctggtgacaacaagactcctcagagatgccaatggcaatgtccatgccaacgccaattgtcatggtcactggactcctcacattgcctgtgtgaccttgtttaaacatgttcctgcccgccaccactcaaggttccgagtgggaaaagttaagttggctaaatgaccagagccatgcaggtcgcgaaacataatggtcgtatttatcgatgacgtgtcctctgagcggtctgtggagaagctgatatcgccacagtgtgtgcaattctcgagttgtcgtttgctcacaattgccatagaggccacgcgcttgcacctcccccgacacaccacttgctcccaccgacgattcacctccttacttcctcatgcgacatccacgcgtctcatctaccaccgcaagtagggattaaccgcctgccacatgatattcacatcgacaagcatttgcacaccatgtcaccaactgctggcggcctctccttctagcggtattaacacaaaatgtctggtagtggaggaatttagactgaaacgtggggaacttctccaaacgatcaagttattaatcataatttaatcgttttctaacgcccgccgcccccgactattagccctgtcaccagagtctgtcaaaacacgtaaatcaagatagacacgattttttccctcgacgatcaccgacgatcacccagctcgaattatccacgaccacgaagcattgcatcacctctgtcatgccgcctgctaaattacgtgccgtacatgacgtgtgtgcttctttggctttctcttattcgttcccctggattaatttatgccatgcgcgtggagaaactgaaagtgaaaatgtcgaggcatccaattcaggactaacccaaacccagtcttagtcatccatctcggaactcgaaccacccagatcaaccctaacccttatcgcaggacgctgaaaaaaaacaagattctgcatcagttgacagggctaactgaaaaagaccaaaaaagaaaaaaaagaccaacgaaaaacgcaaacagcacgagtacagtaccctacaatgactacaaaatacgaataccattcgggcttcatggaagaggctctcgaacaggcagaactgtcgctcaacaataacgaggtgcctgtgggatgcgtgtttgtgcacaatggcaaggtgattgccagaggcatgaatgacacaaacaagagtctgtgtggaacccgccacgccgagtttctgggtatcgagcacattctcaagacacacacggccgatatctttgaagaggtcgatctctacgtcacagtggagccgtgtatcatgtgtgcatctgctctgagacagctcaaaatcaagtgcgtgtactatggatgtgcaaacgaccggtttggcggctgtggaagcgtcatgagcattcactcggacaagggagtcgaccctacctacaaggcataccccggattctaccgtgaagaggccatcatgttgttgagacggttctattgccaggagaacgaaaatgcccctaccgagaagaaggagaacaagaaacaacgagaactgaagacggcctttcaaccgtttgatttcaccaaatatgtgcattcggaggaggagtttgtcgaggtttacggcgaggaatatttgcatctataccaggagagtctgaaggaaaagctcaaggagactggcaagggagagaagaagagaaaaaccaaaaagtagacacggacacgcattatagacatcaactaatatacacacatttacatctacagcacgaatatgtaccaatgtatgtacatacatgaatgagaagcatctacaagtacaagtacccgtgctcatacaagcacatacctgagtcttgtctacaatttctgttacaaatagtcatacataccctcactttattactgcgaattatccctccaattccttacctttgtgtgtcattgtgcaactcgagccctgctctctctcgcacacaaggaacccgtagatccgtggtgcaaactgtccatcgtgctaaaatgtacaagtgcaaacgtttgattttttgaagtctctggttgattttttgccccgtttgatttgtagatataaaaaatgccgttcgataactcagaacaagagcgacagacgctgcgcgctatgcaacaccggcagcggctctctttcgcttctcaagcaacgtggcgccgtcaagtttgagctcaaacacgcctgatcggttcttttgcttctggcgcttgtgggcgtgagggttctcggccaccgacactcgagacatgcttccctccagagtgtcgtcttcctcgtcctcttcgtcggtgatgatttcggtcaacatgccgagattcttggagccgcccattcggcgacgtcgcgcattctcctcctccattcgatgcactgcgttggacacgtcaaacacctccttgagggtgacagtggccggcgaccgatacgttgcttgaggatcctcaaacgacgacgtggaggcgccctcggcagggtgctcgacatgcagagttgatgcagagtcgtggggttgaggatcttcggcctcgacgttctctcgcgaaatggcagtcgtggcgggagtgtggccctttcgctggtccaaaatggacgccatgggagaatccaaagcaggatgggtgggctcgttgctctgggtgatccagggatgagccagaaagtcctcaattgtgtaccgacgctcgggatcgaccgtcagcagatgtgaaacgagatccttggctcccttggagatttcatcccaccagggagacaggaaagtgtattgtcctcgagcgaccttctcggtcagaacatcgatactgtcgtcgtagaagggagggaagccacacagaatagtgtacagaacgcaccccagagcccacatgtcgacagatttcgaataccgctcatccttgacaatctcaggagcggtgtatccaacagtaccacaaggagtcatggttttgctgtcccagaccaccttggaaagtccgaaatcagccagcttaataaccccaatgcctccggctcccacgccgggaatgtacttaccctcgtcttccttgctctcgtcctcaccctttctcaacacaatcttcttgctaggggtgaagggagcagggtagaagagcaggttttcgggcttgatgtctcgatgcaccactcctacctcctcatgcaagtattgtactgcttctgcgacctggacaatcacgtgtcgggccaggtcttcggaaaagtacgtcagacgcacaatctggtggaacagctctcctccaggaagaagctccaaaacaatgaagtagtggttttcgctttcgctaaaatcaatgagctgcaccacattcttgtgccgtaattgacgcatgattgccacctccttgaggatactcgaacgctgagttagtattttgcgactgcgggtataaccacctcaatccctgatccttcattaacccacctgtgttgccttttgttcatgcttagccttgtttcctaaatgtcgcgacttgtgtcagtggtgtctttctttcctgagtgtaggcacaagcattcgtttcttctctctctctctctctctctctctctctctctctctcgctctctcactctctcactctctcactcctctctcctcacaagactcacctgattggcgtttagttcaaatttccgaatgaccttgacggccacctcctccttggtctggagatccactgccttgtagacaatggaaaatgcgccactatgttagcatgttgagataatgtactaaccgcacacttatgcgggtttagcgcgggtggtatttagagcccattggcgcgtgaagcacggaacagcgctacaagtacactgggtatcagttcttcttgcgtcgtcacgtgtctcaaacgcctccacctgttttgcaggccattatgcttattaccaacatggttggaaattcgcgctagtgacatgtgacttgtgtcaagtggtgtagtcaggtccgagtgtgtggatgtagtagctggacatggccagacactatgtcctcaccgtccatggtgaacatgatgtaagcgagcgtgtcacaaaataattaacaagtgtgagcacacactttaaccatactcccatcatcacaccatgacccaaggaaattgaacgacagacatccagaatggccatatatatggccgtcgtaagcatccgcctgtcaccatacacaaccccatgtttccctcccgtttctcatactcactctcccatcttttcaatcagcctgtatctctcgagtcccgggtagttgggaattttgctctgttgcagcttctcctcctccacaatctccttgatcgcgtcgttgtacttctccttgtcgacttttttggcgggagcagcggctttggcggccggtgcgggctccttggtctgagctgcgccctcgctgaacattgtggttttggtcagcggctcactgttactgtgggtgatggcgggcggttgttggcttcgtcggcccgagttacgggacgagatgggctccaggccgttctgggcctgttttccatgccgaatgaagtttttgaggttttcaaaaacgggcattgtgtcttatcagaggcgtggtggtggtgtcgtgagtaagtcagaaacaagaattggtgtcggtgggagaaaggagtgttttgactgcaggtgcaggacgtgaatgttctggggatgcgaaggtggtgaacgaggggatggtggtggagtcgtggggacgccggttgtgagatacaaagcagtacagtatgtcagcctacggttatccctacgtctcctctcaaggcataccttgatcgctacttgtactcctcctcccactcatcgtgggtcattgctacaaggctagtttttatctttgccgcatgacgttgcgttattatggcacacggctgtagtggggaagttgctggcgagaagagtggctgggggtcagggggggggggactgttcacgataccaaccgtgtctcgggcctttgtccgaaggtcatggccgccgttgtgaccagtcatttccgaccggtcaagtccctgttaaccgaaccccgggccttccattgacgtcatcaacacatgcgacactatgtacccgtacaggctgctatctatgcaggttgctggaagtagcaatgcacacgcggcatggtttggagcaaagaacaatggagcaaggaaacaaaaatattaaaatatttagagtcttgtcttgtatgtggatactttggacccgaccgtctgcggcgctcaaatccccgagttttcgggcgcacatggcacatatccgccgcaatggggctcctgggcaacagaatttgagactctcccctctctcaaaccgactgtctaatcaggcaaggtacccgatcgaccgtccatttagtctcacaagcaatgaaaaataaaataaagtcgcggctttatagttggcccgaaagccagggtgtgcgtttttcgagacggtcttttgaagggcgtaggaaaacgctacgagattgctgacagtttgtgggaccgcgattgaccgtcgtatttcgattccacagctcaccaaaaaggcatattcgctacaagatcccagagacccatccttcggtttgtccctttgtgctccatgcatgtccgatgccccccgagatggcgtgtcgtcatatgacatgaaccgcacaacaagggcgtttcaggtcctcatttacgcgagaagtcttggccaataccgtgacaaaatgggtcctcctagaagaatttattagaagaaaaaaaatacgaaatgggatcgtcctagatgcccaacaagactccttgcctttgccaccctaacgtttaaacggtgtttcaacggcgcaattcagtacatgcataccaccaccggaatgggctaccagtagctagccatgatactgtgccaacaaggaggtgtacattggattaatggagatagagagatctgaaatgtcggactctgatggtccgtcacttcctgaaccccagctcacgtgaaacccgccctaacaaaccttgacgacgatccttcggctcggatacgccccaatacgatgtaagggttccagactggtgggcgaacacttagttttccaacaataaagagggtagttttgtgagctggcggttggcccttgtagaggggccatgggacctgtaaaatcgcaccacaacaaccgcacctatatgaaaaggagaagatcaggctacttcatacagtacttgtgcgattgcaatgttctggcatcataaaccttccacttactcacgagtgactaagggtccttaacatgaagggctacgctgtcttataccataatcatagtgtgtctgacaaatagcagtttgcctgcgtcttgtacttttgaccgatcttcaagtatgttctgtaaagtgaatgcaagtctggtgcacttgtagccttggttggttgattatatctttacttgtactacttgtagtaactgaaacagttgtgagtcatgagtagtacatatacaatagaccgccccactcggagcgttcctctacaaccctctcagttcatctcaaacccacagttgggtcaataataatatatatattacaataatttaccgtggtccgaatgaccaagctatattttggaacggcgtatggcattgacacaacagcctattccatggtggtatcggcgtcaacagtggaaccttcaacatcctgctgctgctgctggccaggaatgagcttttcagttccctcagcctcattcacaaactttcgctcagcagtgccgtttccatgaccctcgggatgcgagaagatacaattgttgttggcacagttgacgccatacttgcatggcgtctccacgggatgcatgaagatgcagtccattcgggtgcactcctttccgtttcgacaaatggtcttggacatggcatgtcggaaccgacatttggggttggtgcagtagttgttgaacttgcactgctccagagtctggcctgagggaagagactcattctcacgcaccaacgacgacgacggatggttcttgacacactcaggatccgcacagtgctccttattgtcgcaccacgcaaaatggtcggtgatcttggcctcattgttgcatggagtaggatggccataagtgcaatgctggttggcacaccggtctgtgaaccgacactccatgatggtcgttttcacgggcacctggggaaccatgacctgttgggggccttggggagtcatcatgggcatgagcataaagcccttgggaactgcaggcttgtatctctcatagggcacccactcaaacggcttgggctgctcgggaaggttggccagatcatcgatatcctggccaacatgcaccttgagacacgtgccaggaggagcagcacacgctccaccgttggcaaacgcctcacatgcctctgtgggatgcacgtacttgcagttatcgtagttgcagttgggccagtttcggcaccgatggttgaaccgctcctttggcggaagatccatcgacagcgctttctgcatcgtcgcgaacatggcctgctgtgcgtccgtcggaatgcctcctacagaacccgtaggaactcccccggtagatgtgggcttgctcctgatgctatattccccctccttgctgaatgccttggacacgccgtttcggccgacccgatccttgagcgacttgcccacgcctccaaacgcacttcgatcctgtctgcccttgaaaacgctctctgttttccgtcggccaggcatagaccccacgctgtattcatcctccatttctgtgtcctcctgtaccgcaccgccgtgttttgccacgcgacccatttcgtccttgcaccacgccacaaagtcgtcgctgagctgcccctcggtcatttgcttcacctctgacttgattgtgtcctcggtcacgtagtcgtctagcagcatcatcacaatgtactgccccagagtcgggtcctgctctgagcccataacctgcgtggcccgctgtaaaatgttcttctcaaactgctccttgagagcatcgtcgtttttcaaaatgtctgccatttgaaaagttgtgtgtatggtggtgtgtatggtgtgcggaggtgctttctagaaccacatgagaatctcactttttcaaccaaacttcgtcacgtgagttaccctgcaggttggtaaatgtcttgatggaggctgaattaacagtaaaataaggttccagagaactttacctaatatatcgatatgaggtatcacatgatctaagaaaatctcgctctttttcgctcataacctgtacccgccacgtgttgcggtggccattgtgtcgaaaaagaaaaaatcggcggatttagctcagttgggagagcgccagactgaagtcattcttcggtcagagtaatctggaggtcctgtgttcgatccacagaattcgcaatttttttggagatgtttcagacaacacacacattctcttttttgtcagtccgactgtaaattcaagcggttgcgggcttttgatagtactccaatttgtttttcaacttcctctgtgtctccacacttctagtctctactcccctcctaatctcaatacaaccctactacttgtatttgtaggtggatacggtttgtcagatggtggataaagtgcaaacggcatcaactctaccatctattacattccatataagagatctgtaagcgtggttgtagttgtggagataatgttcttttcgttccctgctcttctggctcttctggctctctcagctctttcagtagctgcaccctccaaccccaaggtggtgtctatggatgtctctaaaaagacatacctagggtcggtcaaggggagacctggggtctatatttccacatacatcagtgtgggcactcctcctcagtcattcgaagtcagctttgatacaggatcttctgatctatggataccagccgtgggtgatgaccaaactggaggtccagggctcttcaacccccaggcttcctccacgttcaaatctttaggaaccagtttcaacgcggcatacgtcggaggaacagcccagggatactgggtgaccgataatgtcaacgcagcaggcctgtctctgtccaatctgcaacttggagctgtttctaacatgcaagaccagaagcaaggaatcttgggtgtgtctttcaagcaagtagaaatgtcggtacgaaatggacaaccccagtactacaactttccgttttccgccaaagaacagggctttattgaccatgtgctctactctctccattttgacggtccccattctcctgacggaacctttctactgggaggtattgaccacgccaaatactctggagatctccattactacaacgtcgccaaccccagtgcaggtccccagattaatttcaagagcctcgtacttgacggacacgaactcgacttcaatctgccggtcacactggactcagggtcgctagctattgcctttccagacacccagttcagagctataggaagcgggcttaacctgaccaactacaacaaagatatgggtctgtattatatcgactgtcaagcggagatctccgtggacttcaaattcgacggactcacaatctcagccaactcttcgtctttggtactgcccatgggattcttctcaggggacaccacagacccttcatgtgtactgggagtgcaaaactctgccctttatgaatctccgaatgatgctgttctcggagaacctttccttaagaacgcctacgtcgtctacgatttggaggactacagcattggactagctcctgctgtctacaccgacaagtctgatgttcaagctgtctcccgcacattgtaaacagtttacaacctctttcttacgtcaattaaaacaatgcaattaacactcctaactgtaactaatatcgaacatctcctcgtcaataacaccaaacagatcctgcatcagcttggctagaatctccagctcggaggtgatggtcacacagaccagaatgtagatgtacaggagcgcaaagtcgttatctgtgatttccgaaccagctgccatgacgttgttttgctcatactcttcaggttgactgcctcgatagatattcagtttgaccatcatacggtctcgagaatgcttggtggagggcaaattgtctgggaaggggaaaccaagcttcatggcagaggccagcatgtagaaccgcaggaaaattcgatgactgagctcagtacgttcagccagcgtgcttttgagcagaacagcttcatgaggagtcgtggtggggtccttttcaatgaccagtcgcaggttctggaacgcatcaaggatcttctgtgttgatttgagaatgttgtcgtacgtgttcttagggaaacggcccttgagacgaaactcgttgggggcatgtttgagcagaccgtccagctggatcaatgtgttctgcaactggggctgctcagcaagcccaaccaacctataccctccagtagcaggatcaaattgggacgccagcgggtctttccacgtaagacccattcgcaaccagagtgaacacagaccatgcttgagattgactcgggccttgttggggagcaatagaacagtaaccaggaacgcccacataactccagcacacacagaaacgaaccgatggaaagcaatagtacctaccagaggccttagacctccttcatcgtcgtcattgtcgttgtctccaaggtacaacgagtacgaatacacagctgtaatgttaaaggtgagcagaacgaatcggccaaacgcattgttatccttccacgtaacaatgatgcggaaacaaggataagaaatggcagctccaatcaatgccaacatgtattcgttctctgggaacaaaacccaagacacataggcacacatagcacccaaaaacgtaccgataattcgtttccaggcagtccaagtagtgcctcctactgacttggacatgatgaccacgtaggaaatcaacccccactcgcccctccatgtatagaaaattggctgaagactgggcatataagcgggggtagcaaacatagctgctccaatacctaccctaattccaaattggacatctcgtcttctaaaaacacgcaggcgtttccacagacggaacgacatagacggcttttcgagctctccgtgctttgccttcttagtcagagcactattgagatcatcatgcattcgcccagcaaacccctcctccagaagatcagattgtcgagtcatgaacgccatggtcttacgtccactgatgatcttgttgactgcactcctctgggaagtttctgcctcctctgctgccgtcggttctctatgcttgcctccccacagccatcggtagcttctctcgtcgttttcacggatggtgaggtatccctctatgcttcccagcaacttttgcacctcagaagccatttcttcaagcagcagcgagaagttaccacacgaagccgccacctgctcccaatcagtgatgaactcgtcattgtgccttcgcttaaacagccccaagccgtagacttcagccagagccttctttctggcttcacagaatagctcctcagcaagaccaagtgatctctggtactgagcaacatccgcctcggcatcgcatttgtcgagctccgaaccgtgcaagatccgcttcatggtcagggaaaaagacttcatgggtggacccaagtggtataagaagacatcaaacagattttcaggcgtgattgtaggctcattgggttttgtagatgcaaaattcggggaaggaagagaacttccaggggtagaaagagttctcttcaatgagtgtctttttctgatggggctgtccttaaacagctgggacagcttctttcgcgtcaatgtagaatgctccgtttcaacacctgaagtaagagcgttaagatgctgatgaatactgttcatgtgatgaacgagcttctccagctggtggtattcatcttctcggcctgtcaagtacagttccagcttcgcatgacgaatgtttctgaaacaactcagctgggcacgcagcttggccttgagctcaatgtactcgacgctgtccacgtcgacagcccgcataaactgcctggtaagatacagaagcatgtctccatatatgtccatggtgtttgaaatggattgcttgagttctgtgactgcagaagttctccagagcgttacacaaaccagagcagacacagtacaaccagtaatggcgagcaagaagatctggttcagctgttccaaagaaattctgccctgctgcacgtttccctccttcgtcagcacactaacaaggcacacacacgccagtgaagtggcagtgttgaaagtcggcaagtccattttctgcttaacaaaggccagagtgcccagtcccacggcgcagaagatgactaggtcgataatgtacgccaataggcgcatatgcaagtcgaccagaaatgccgacactaacatactcagagaacagacacaaaaggagtacagcagggcgatagatgcaaaaataagagcctcaaccatacttcccatggttcttcctgggtggaaataaataactgaagtggcaaccatatgtttggagtcaccgttacccaatagtcttgagagacggtcgttgtagacgaacacggttcctagaaggtatcccactgaacattttaagacgacctttgcttctggatcgatccatgctccagtggcgtaatatttcagtttcccaaacactcctgtgggctttggtttgtgtctgtggcacattgtggggctgtcaactgtcgatacagcgtagttgaaggaccgttcggggtccggttctggcgagtttggagaagaactgctgttgggttctccaaattcggtgatactgttgtaattttggtacgttgtctggaaattgtttgcgtttgcgtttgcgtttgcgtttgcgtctgctaatgcctccagttcttcaggcgttatcttgattgtctgtggcaccagtcgcccttcctcgttgctgaaagtcacttgtcgtcgtactcgctgtcctgtgtttggcaggatcatggaggcttttcggaataggggcagcgtgatgccggccctcgtggcccatcccacgggagacacagccagactggaggctgctgtgctgcccaaaagtcgctgagatggagatgagggcatggatgtttgctgcgacgagtcctgctcaccagtctcgctgtaccacgagtttcctcgaatggccagcggcctgacgttagccttggggtcgggctggttcattatcggttcatagggatgtggccgacgagctgaaaagggttggagcgttggagagcggtgcttgaacagtcagggacaatatccggatgaaagtttggaacaataacatggtcgtgcatcacccatgcaattcctccgcgaaaggtgaagggacccagatggctcctagacccgagggggggcaacatctattgcggtcacgtgacaaaaatatatcaactgtggatggctgatggagtttctatgcattcaatatatggcttcaagccaccatctatcacgttctgctgcccatctctgtcagccgtgtgtgttatgttattatttcgccggaagccaaaacatgagccaaaataaaaaggaataagggcatataatttacacacaaggcggacggggaagactgtgcgtgacaatgcgatcccgtacaactacttgtagttcgaaaactccgtcaacatgtgatccgattgcgacaagccagtcaaatgtccctttcacaagcactaaacacttgaatatactcaatcgacccttgaatatactcaatcgacccttgaatatactcagtcaacacttgaatatcctcatactgagtatcgatccacacttgaatatactcaaccaacccctgaatctacaactgcaggtgtctacagcatgcatcgtctgaggtcattttgtacagtatgtgcgtgtacgaatgccggtgcaagaatcggaacgagtaggacaattggaagcacgaagacgtggcttttgattggccattctggtggtttacagtctcggttcaagtactttccttggggtatgtacagtagctattcgtagagccgttgtgaaggatgccagaagtggtttagtaactactactgtagttatgaacgagcactcgtaccagaaaggaaagacaagactttgaagtgagcaccaggaataatctccagcagaatagttcatcattttttacaagtagccacaatgctagtacaggtacatcacccgcctgtcgtatcaggacagatggtacttcctgcaacccccaattccgacctcggagttctccaggaaacagattatgagctactagacgacattggaaggttcctgggtatgtaacaaacacaattggtttgcttgaggacacacaacaagcattcttcatcaggtggacccttctgactcatctctactcagcctttagacgctattgagatgtacaagtacagtatgtacatatgctagttaaggagcagttcatacacgtatctgttgcccaatctggataaatattggaccaatcgaatggtctcaactcattagaatccagccatatctctgtctcttccatattgacctgatgtctcgttttttttccttcttttttccttcttttttgggggttaatttaggctaaataccgtctgtagtgtacttatacttattctataaatggagatagacgagacgcgaatagagtctttctggaaaacccattaagtgattccaagcagaaaatccaacaaaacccgccgtacccctctcgacatactatcgtacgcccgtacgctctccactggtgcacttgctgccaaccactatcaacgtcacgttactgaactctatctgggctgtggcaaccccagaaacctacagtccaccttcgctgtgcctgttgcaatagggagccaaacacttgacgacctgataacgacggtcgacggagcggcacagacacagaacaagacgacaagtcacaaagagccccactccaacaacagcaacaactacaactacaaccacaccccatcaaaccccatcacacactctcactgcatacgatggaatggcaagatgaagcggggccttcgagtggtccttctaacggcatagcgtcatcgtccaacggaccctcgtcgcactcagacacagacctgtatcgaagcgactaccatgcgctcgaaaatgacaagacttatatcgactctgtggtgagcgatccggccaaagacctggatggaacccagaacgcccacatcacatacctcgtgacgaccaagtccaacaacacgcagttctcgaacaaggagttccgagtccgacgccggttttcggactttgtcttcctttacaactgcctgaacaacgagttccaggcctgtgtggtgccccctctcccggacaagcagcgtctcgagtacattcgaggggaccggttttcgacagagttcacagtcaagcgagcagcatctctgacacggtttctctcacgcatagcacatcaccccctgctcaaacggtccaaatactaccacgcctttctggagtctggcgaatggaacgcatacaagaaaaacaacattgcacgaggaggactgattgtggacggaggaattttggacggactgtccgacacgctggtcagtgcattcactcgacccccacagacggcccaggagttccaggaggtcaaggaacgaatcgaccgcctggacgtgtgtgtgtcgcacattgaaaaggtactggctcggtctgtgcgtcgacagtcagatctggtcatggactaccaggacctgtcgcagcacgtgggccagctggagcatctgattccttcattggaacaagagttttccaagtttgctggaggcctgcaggcgctggccatcaacacagccgtgctcaaggagaaacttgataccgactacgtgtcttctctcaaggatctcatgcactatcttgtgtcggtcagagctttgctcaaacaacgagaccagaagcaggcagactacgagggcctggtggagtacaatgagcgagctgtggccgaaagacaggcgctggtgtctggtggagggaacggtattctgcgaaacaagctggaggacattcggggtatcaaccatgagttttcacgacgggaacggctgcagaagctcgagggccggatcgagagtctcacgggcgagacgaatctggccaagaccacgtccgaggcctttgacgagcagaccaagcgcgagattaacactttcgacaagattcgatccggcgagatgaaggagactctcaagactctgacctctggacaggtggatttctatgcggctttggtcaaggattgggaggctatttacgatgctcttggagagtgacggtattcaagtgcttacctaacgataataatgataatgataattcgaagccattgtgcactggtttattttgatgatgatgaataactccgataacctatcaattgacgccacccaaagttgtgcaactccactactcgtatttgtatatattcaaacaagtctgtacaagaagattgataaaggaagttttaataaggtttcatatcaattttgaacctcatcattatggacccttcaaagcagtgagatggaaaggtcaatttttcatgagtttttgtgtgctcttagaggatggcaagaagagttgatttttcgatttccagcttcgcagctgcactattgagttgtatttgtctgaggtattatatagtatgtacacggaatatacagtagattgataacattcacacgatatatgcactgtctagtgaagcgagtgaagcaagtgtacaggaacacctgtcatagatcatactgttccttttgatctcttcattacgggtgctctcctaatgtccttatcgccaaatacatctatgctaattactgtacgtactgcgacactctatataacctccttcctcatttcctcatttccacctatgcttatgcctgaagaggcaaaggagcgtagagaacctgggtcacgtacttacgagagtaccgggagaccgaggccacggccagaacgttatgtttgatggacgtggtggccagatggttgagaatgacgtggttggggatgggcagcaccgagttgtcttccttttcggtggagtttgtgttgagaatgaccgagtccagatggggaggcagttggggaggcgtgggcaactctttggagatgtactgctccatcacttctgtgtcggtgaacagagccgggatttccggtgtgaactcgtactcctccttgggcagatcttcttcagtgaaccgctcgtagcctcctcccagatcgtcgttactggggatgatgcctgctcgagaaatgggatgcagatccttctggtcggcccgttcctcggtgtccgatagacccacctccacgtagttgagaagattacccatggagtctgtggctgtggggaggtagtctgagcatcgcagctcattgtctacgacaaatcgcagtctgtgggttccaggaggaagatgaagggtggtagagaagacgcccttcttgttggggtccggggtcagagccaccatctttctccaaccagtgaaggttccagtaacgtagaccttggagcctccctgagtccatttgatttcgagggggatctttccttcggtcacctgaggggaggtgagttcgatctcttcgccggagtccacccgtgacagcggcttgggctcgttggatgtgggatgggtgatgttgagtttgtcgaaggggatatcgtcgtcgttctctcccacgggttcgtcttcatccagcagcaaagttgactttcgtcgcatcttgggccgctgggggtggctctttgcgggcgccacggggacggggacgctttccggagcaggcgactctttgtggtacgaggcgggctcaaatgggttgttgaagggtgttgcgctgacatgcgacgagttggcggacatttgctctggcgaatggctcacatggttctgtgtgttgtcggagccctcctgggggatgggctgcggatcggcggtgcccttggggtcgtgatggccgttgttgtccgctggacggtgctgccgagcagctccattgttgttggcctcctcctggctctgtgcgtttcccatggttgcttgggtggcggggttggggggtgattcgggtattggtgttgcggggggcctgtggcggggcgtcgtacgggatccagcagtggtgttgctcgaagagtacgcttggagagagagaggactagacagcgtttcgcacccgtagatattttggatttgcccaaaagtttaatctacacgtaacggcaacggtcagataacgaacatggtgcgtccttcaacaagtggacggcggggcaagcgacgggccagagccgccattctttttgcgttccccggcgcatgttttttgcggtggttatagggctggttacgggcgccgtttgcgctgccgaccgggtccgggatccggtgtctacatccgcgccagccattcacacatgtcaaaaataaacagtgtgtgtcaggacacagtggggcacacgctggaaaataaaggtgagctgcaacagtcaggctaggaataattatttgagcgattttcgagtggttttctcgcctatcggccccaacgcagggccttccccacccgggcggtgggtggtcacgtccacaggtccaccgggctgctctagcgggtatacttttgcgttccacgtgaccttccgttgccttgctgcacacatgcggcgtttttccgaggcctagcaaggagaagattgagcggtttagtcgggacattggaagttagttggagttagttggcgctcttggttgaaagtatcaaaagtggccagatgatgcagaaaacaacagacaaaacaacagaaaaaaacaacagaaaccccggactgggtggtgtattatgtattaacagagcatgcgttcctcaatgggcattcgtaccagtttcaggtttcatatgagttcaagcaacaatgttttgagcctgaaaagcataaccgctctctgccgtcccgctcaacatccgctctcgaacagacagcaatttaggaggacggaagaagaaatttgaaaggatcaaagtgtcaggaattgacgagttttcattgatgctcccgaaccgattggaggacggaaggaccacggttgacccaacttccgagcaaatctgaacattcatacaagcgccaatctagagagagacccacacaacattcatgtctcatatggactcggccaacaagcaacgttagcaactccaccccataacatcgtccgcgaggatggagtaaacgacacacgtcattcatgtgcttgtcagacgtatgtttgagaaaaatgttgggttggaatggaatgagactttggtcacgtgacgttatcaatcggcgggtagggtaggtttgcaactcctgggctgattgtttttgggtggtgtgaacttgtagtagtatgtactatagtaagtcgggatgcttcaggctgtctaccttgtaaccaacaccactgcactcgaactcgcactcgcactccgatgtgagctatttacacttgcgacgtagacgacggacgcccaagacgatcgcggtgcctgaaacagctgaaatgagcgattggcaactctgaggagggctctttagactctggggctcggccgtgtgccatggagtctaaccgcaagagtgaggcagcatgttgagagaaagacaagcagacgaagacatgtagagtgtaccacttgtaggggctcgagccgagatgcagcgctttagggtgctttatcgacacgaaaagcgcgacaggtgaaacagaaggtgtcggccatcttgcagtagcccgatgaagagactctcacttaggcaccccctatccgcctcgctgcaagataaccggacgcaaatgttgatttcatgcacacctggtatggtgacgcctgcgttaaacccaagggtaaggctgttaggagtcgtgcaaaggcgtcggttctggctccgttgacgaggcagtctgtctctgcagctctatcacacatatatatgtgcatggagcgtctgtatcatgtagtagtagcggtactgggtgcatttatatcaggtcgccttgcggatgttcttttttggcttggctacctttttttaaaacaattatttaatttttacttttttgaatttttttttttttctttttcattgtgcttgtcccaaccgacacttttttacatttaccctacccgcatctcagcaacactccagcgacactctactgctatacaagtgcgtgtgcgagagcgttaaagacggcaaaagagagttgagagagcttctgcagcacccaaaaaccattgcagcaacacaaagctttgcgagcgtcttcatcaccactacccccacctctcgatacgacagcttgcaacctcccccaaggcggtagtgtctctgttcgccacacagccaaagtcacatcgacacaaagacccctgcagctgcttcagtagcacattttcgaaactacttcccaccacacttaccaacatcatgtccaacactctggtcaaaaagggccagggccaggcggcatccaacgccaaaaaaatcggctacaacaaaaagaagggcggcggccagaccaagggccggcctgcgtttgtgttcaagctgtggaacatggtcaacgaccctgcctacgacgagtacatccggtggatgcctgacggcaagtcgttccagatcacgggccgagagcagctggagaaaattgtgctgccgcggttcttcaaacataacaacttctcgtcgtttgtgcggcagctcaacatgtacgggtggcacaaggtccaggacgtgaccagtggcagcatgcaatccaacgacgaggtgtggcagttcaagagccccaacttcatccgcggccgcgaagacctgctcgacaacattgtgcgaaacaagggaaccaagggcagcgacgaggaggaggaaatggacatgaccacactgatggacgagctgcaacagatcaagctcaaccagcttaacctgacccaggaggtcaacaagctccgcacagacaaccagctcctgtggcaagagaacctgggcttcaaggacaagcacaagcagcatggcgagacgctggagcgaattatgcgcttcctggcctctctgtacggcaaccagggcaaggtgcttggagaagccatctctggcaacagaaaccagcgtctgcttctgggcaacactgatcccgcccaggctacacatatgatcaatgaggcggctgcagctgctgccgcagagaacagcggcaacttcccctttgagatgaacgacatgttcaacaacaacaacaacaacaacaacaacagcaataaccccaacgacagcccctcgtttgcacgagtccagccgctgtcctctaccaactcaccgcagacggtaacaggatctccccgggaagaaaacaacaaaacaaacaacacaaacaacacaagcaacaattacgacaagattacggcatacgacaccgacacgggatcggagcttcccgacaacctgcaggacctcactgacctgtcggacttcacaccctccatgctggacccccagactgtgcagcagtccatggagcctcccatgggtttcggggacctcaacaagaattcctcgttgatactctctaacaactccaacaactccatcaacatgccccagacgccaatgcgaaacaactccactagctcccatagctcgcagaacatgtcgcaccacaactacaactaccagcccagcacgcccggcgcgttattccctgagctagaggcgttccagggcgccaacgaccagctgatccggtcggccgagcgtccccgaaacaacctcaacatcaacggcaacggcaaggccgacgatctgcagcgacagcttcaggatcatggccgtcacattgaccagttcactgaccggctcaagaagcagcagggataccagccgcagcagttgcagcaccagcaacaaccgcagcagcctcagcagcagcccaccccgatgcaggcacctgctcccacgccggcatccacaatcagctctgcacctacccctgatcctacttctgacctgttcaacgtgggcgaccccaacattgtgcccatgcaggatttcaacatggacgactacattgataacgaggcggacatgtttgaccctgaagtcaagattgaggaagacatgcctctggtgacagagttggattcgcctgcgcctcggcctaagaagcgtaaggctggagagtaggaggagaaagaaatgcaaggaaagttgacgaggaaagttggtggaataactctgatgaagaagagtccacaacgaagaaaacggtctcagcggagtatgagtatcataggtaatttattgcgtaataaccatagctatattgcagtacatggtgagttgggggagcaaaattcataatacagagcaatggttgtctatgatgcgatgatcgcagatcgaaatagaaaaatacatgatctcaagcagagaagtcgatggctacatcagtaaccagatagttgttcgtacaagcaccatccaaacatcattattcgtaattcgtaacttttattttgattttcaaggatgttcttttgactgtaagtcacatcacgacacactttttatccttgccatctttggatttttttcctttggtcttatcgggtctgcttttagtggccttgccgcttcgggtctgctgctgctgtcgtcgagcagtcgtacctgccgtgctagtggttgtctgctggggtcgtcgacgctgttggtcttcttcctgaatctgtctggcgtactcggcgtcgtcctgctcctggatctgcttggcgagatggaagtcgttggtggcctcgactgtttggtgggctcttcttctcgactcttcctgttcctggtctgtcatcatttgtaccaaatcaaagcctccggtgtaaaaggtatcgtctgttcccgaagttccctccagcgaaatccacacaattccgttccgtccacacagctctctgtctgtcacgagactaaagagacgccctgaggttggctgtttgtacagagtggcaaagtggttgttcctgaagaagacacacacagaaccaggaaccaggatctcctcaatgtaccggataccgtaggtggtcagctgtgaggggttctcgtccatgaagtcgaacgtggctgccagttgtcgatgcagtacctctcgttccctttgtttcatctttccgtcttcggtaacctcgatctgtaatagttgggctgcatcgtatgatcccacctccattacatcgtcatggtacggctccttggggtctgcgatccatccatgcactacatccacctcaaaggctctgaagagagccagctcgggcccttcttcaaacgtgccgtcgaaccgagggttgatgttgagaccggagtatagttctggcaaaagtcgtagacaggtgttgagatcgtctgggttgatatgaggtccgctttggcggctgccgatactgaggagccactgtccgagatgatccagtagcaggtttttgctcaccatctctttgttctccaaaagagcagaaagtggtcttccggggcctggagggatgggagacatggcctcggtgaaaacgagggtgttgaccagtgcgatgaagggacacgggccgttttcgtcctggaggatgatgggtgttttgaccaggtagttggctggtgttctccacttgatgaccttgacctggaacgtgatattgtcctttggtgggttgaaggtgagcggtgctgggatgatattctgaggaggaggagaagcagacttcaggataggcgatctgactggtgacctgactgtcaggggagccagggcactgtctgaattgccagcctctggcagacccagctcctccacatggccgtctccaatatagctggctctgtttgcggggttgggttggaacgatgtgaaggaatggatcgagtttcgaatggagcttgtaaagtccacgtcggacggcgtgttgctggagcctccctggacgtcgagatagtgcatcttttcgggttcggcggggatgttgacggcagacacagaggtggtgggcacggtggcaggaatgtcgacctggctgcgttcgacaatgaagtccgaggtcgtgggcgtggttgtagtgtgcccctggatcgaggagggctgtgctacttcgcctggttcctgcatagcctctgtggtatacacggccggacaagagtgtgcctgggcgtggcccgcgaccgctgtggcgctcttggcatggtcgtcagtctcctccgccgcaatggtatttgcgatatcggagtttagcgtcgagtccgccggaggagagggcatcaagtgaggctcggtagacagagactggcgaaaggggttgcgactgggctccgagctcgtgttcaacgccgccttttcgccgtcctccatggccccgctcgcggtcgtctccatgtgccgtatgctcgcttcagatccatccataactatagctgtctgttttgatatggttggtttgttttttcgcttccggttccaattttcaagtcggtgtagtgggcttgttttccccgtgggagcatgcttatatcggagctatctatgcacggtgaccgagtttaaaggggctgtgctaggggggtgtaccacagcctacaacaggagcatttcggaggacacacagcatagagtgaccgacggaccaacaggaagaggacacgtgacctttaatctcacccgattgttgctttttccactctatcaaaacacggtttgcaccctcaacggccccactggtctatgaagccggcccattaagattgtcatccatctacaattgtaggtcaccacctccacttttattcatccacacatgtgaatgaacaaggttacattgtgcctattacaggtaacaccgataacaaagtttgtgttatctccaaggagatatgatatgacgatggaaactacagtatctacaactccaagtgccgattacaaatacattagttgtcttccttctccatatataataaatcatcgcatcctactatttgagcaaaggagccacctttttagccaacatgacaacctcgctcttggaatcccgcatgtcctctccatcgccgtcagccccatcagagttcatgctggatagctggtggatggcatcgacaatctcattggagttcttgagcagatccttaagacgctggtccttggactccagcagctgcagcacggtccacacggcaatgtggccaaacgtagagtcgccgctggtgaggaaccggatcaaaaactcccggattcctccgctgggctcgttccagtggttgacaaacgtgtcgtagttgcccaccttggaagacaggttgccaagcgcagcggcactgttgccctgcacctcaatgttgtccgacaaggtgaggggaatcagaacctcagcgattcccagctccagcaatgtacccttgagctcgtctccgagagcgagcacagccaagcatgcagtcatctcgctctggaccagtcgaggagcgtccagcactagctccttgcacttctgcacggcgccggcctcgacaatctccagcttgtttcgctcagagctggcagcgagatttcgtaaggtggagattgtgtggcactgaatctcctcgttgtcgctagcgcccagcagctccaccagcgtcttaaggaagccggcctcaatgatgggggtctcgttgagagggtggatggagatgtttcggatgcaagcgacggccgcaagaaccagcggcgtgtgagtggattggaataagttaaacaggtgggggaggccgttggccttgacaatctccagctggtagtcggagtcgctggcgaggtttcgcagagcaagagcagcctggcactggacccgaggagagccggagtccatcagcttgatgagatgctccaccagccggggctccgagctagacagcttctttcggttggactcgtccacagcaatgttggaaagagcggtggtcgaatagtactgcacatcggggtctcgcgacgacagcaatgacaccagaatggggatggcgccggcgttgaccagctcctgtcgattctggtccgagtgggtcatgttgagaagggcaccagtggcgtttcgctggactcgcatgtccttagacttggcgagcttggtgagtggcagcagagcgccggagcgagcaatcttggatttgttggcctcgtgggtcgccaggttggttatgcatcccacggcgttgcactgcacctccacgttgggcgacatcatctgtcggatgaggggctcgaagccgcccatctcgacgatcagcaccttgttttcgttgttgacggcgaggttgcccagggcagcagaggctgctcgctggatgtcggggtcggtgttttgcaacagcagcagcacgggctcgaggcagtctcggttgacgggccggatgtccttctctgtaatttctgcaaatgcgagggcggcacttcgctgcaggtcaatgttgtccgagtagaccagagtgctgagggctcggaggggcccgttggagaaaaagtccacttcgcctcggttctcgaggtatcgcagcaggagagccacggcttcccgttcgtcctcggccagcacgggcgcgtagttgccgtcctgtttgtttcctgggttagtgacgactgtggggcgggggggagctgaacaagagagaccagacatacgctgtcgccccattctgtctgcagcacttgctgccatcttcgcccttgcaagacccgctctctgtctgtgtacgatactcacctgaacagcagctcgcacaaacacccatcttagctattagtcgaggtaatcagaagacgtgtgtatattaatggcggtcaagtatccaatctgtcgcttcaccgggatatggaccaactaggctttcgagatgtcgacgtttgtggtggtgtgacggcggtcttgtgttgctacaagagagtgtggtgtgtgtagtcgtcgaaagtgcagtagactttgtgtgggaggggtgtgtgagaagggttgcacagtgcacctaaattgaggtaaaacggggggggaggaagggcggcggtgggagctatgatgcacaagtccggtgcaacaataccaatataggggcgacataatccacgtaataggagcctacatagcaacgtgacaggtgtgagacccttgccccgatccggcagcgacataccagcacctttctctctttctcttgacgcttccctcccgctctacctttggctcttctttttttggcgtgtgtcagattggtaattttgccggcaattatactttgagattctgagcctcgcttcccaaacggggtttgttagtacacgcaccctctgaactaacgaactaaggggcaaatggtgataattggtcagacggtacactggaagcaaaatagccgtcaagagagcctggggttacatgcaacgcatatacggcgttggaaacaccgaaaacacatgtttggaacacccgcaacccgctccaagtcaactaatctatgcctcctacagtcaccctaccgcgtctcgtatatcgtcgtctaagcacgacatactctacagtgcccagtgtatactctactgcaaaagccccggtgcaccggttcaccagcagaaatcaaggctagggagtctcttggggctgccatcgttgggggaggaaatcagattgctatttcggactgcaatcaacgtcgggcccttgtaattggaccatgtaaattagttaaatatcggacgcagcaagcccgtgggattatcagcgcttgctgctgtaatgctgcatggtcaactagaaccctgaagcttagtacttgtaggttagttggccttgtaagcaaatctcatgagattgctttgagacgagccaggaacacgctgcacggtcagaggagaaatggcgctcttcttgggacgcgcttgcggtgtggaactgggcgtgattgtgggcgtgattgtgggctttttggcaacaccagaggagcctgtaggagtcactactcgacgcttgggcgtagaggcattgtatccaaactcctcaaacagagtagacttccgcttggcacaagtcacaggtgtctgcggtagcgtggtgtctttgtttggggtgccaaacacgatgctgctttcttcaatgtcatcgtcgcttcggtcaggctctgaactcaacatggtattgaagttgaagggcttgttctccttctcagcctgatcgggactcgaagggatggagaaaaagtgactggaagtaagcgcgggggacgtcttcgttcgggttggactcaacatgttctccgcagaagctgttcgcacagccaggtcaaccggctttgccaccagaacaacgggcttcttgcggcgcagctgttcgggaagtcgcttgacatcgcctgtgtactcatttttgggcgcaaagaatccccgtagattggtaggcttggctgtcttgttggcaggaaaagtcttatgagttcgagggtgcaccagtccagtggctattgctcgcgccagaccttgtggaatctcggcgccaatgtgaaagtcgaccttttcgtccagctcatcttcaggctcattcaaatgtaccagcctacgagcctcggggcagtagactcgttggtagagaaatgtaaagttggcagcatggaatcgttctaaaaagtcgggtgaggagttgtatccgtccatacgaagagccttaatgatagcctcgggagtttgccatcgtcgaatgtaccgagcagctcgtttaggacccacgttcggcactccatcgcaatagtcacagccagatagaatagccatgtatctcaggtactcaagaggaacctcagagccgagttcgagatctgagcagctggaaattcgggatccatcaactgtgacgcatcctccactcgggtccagctttgtgaccagcatctgtgctccgtagaccacaagatctgagtcttccgaaatgatgcctgtggcgtaacctgccttctccaggtacaccagctgggcgtctgcttcgtagggtgcaaccacaaaaggaatacgttgactcttgagcagttctgtcagttggtggaccatttcctgtgtgattctggtggctttttggaaaaggttgacagcttcggatcttcgtcctcgagacatcaatgcaagggcttccttgtgggcctggtcacgtagtgcgtgtcgtttctcgtcggtcccacgcttggaaggcagtgctcctccatcaaagacaattagcacgtccactccacaccgtttcagaaactccactttgcgcatgacccactgttggggtcgatctgtcggcctgttgagagccaggtcttcggcgcttccaaacgcggccttgtgtaaccatgcaaacccgtccactgccagtcgctggcccttgaattcggaaatgtgagctgccgcctggatcggcttgagcaggggtagtagtccagacactcccatgtcgagtgtgtgtgtgtgtggggaggtgggaaggagggaaggagagaggtaggttggggaggtggtgttcgtgtcggttgtgtttctccgcttgtgtcgttagtcgtcggtcgttaggtcacctcttgctcgtttcttttcgtcttatttctttcctttttgtggtatcaagtcgtgtgtaacttgttgtgtctactgtaatacattgtaaatcgcgacgcgttcagtaactgcacatttattagactctttcactaataagccctaaaaaaataaaataaaataaagagagagagtcccaacaccaacaccaacaccactgcgtgcacgacccacgactcgaatctaagttaacagccagcacacatgcaagcggtgtgaaagtgtgttcgtcatcagcttgcctgggaaaagaaaaaaaaagataacacactgcaacacgccatggcttcgaaaaaaagatcggccagagccttccacgacctcggtgcagaccccaatgcgcccaatggcaaccccctcatgtcgccggacctctcacagcccatgtacggggttcctcctgccggccaagttgcagctgattctccctacggaggagcccagttcggttacgaggcccacaatccagccattcctcatggacaacctgcctacggtcatgctgcctcccctgctgtgtctcatggagcccctctggcccattcttttgctcagatgagcctgaacgcctcggaacaggaggggttcggccacgacgcagcaaacccttctctggagcgtggcaaccaaggaattccttcgctggcagctcgacgaaacgatgcgcgagaatacaccgctcgaaaacccgtgttcaaaacgtttcagaacaccctaccccctcctgccaccgccgaatatctctgtgaggatcagggagtgtctgctcctcccttttgtcgtctctccatgtacaacgtgccagtttccgatcagctgcggtctctgactaagctgcccctcggtatggtggtcaagccctttgctgaacgagacgttcccgtggccgacttctcgcagatcgagcccttccgatgtcgacgatgcatggccttcattaacccgcagttcctgttctctaacggcggatctcgagccgtctgtaacatgtgccagttccccaatgcggttcccggagagtacttccagcccaccgaccacaacggagctcgagtcgatgtcgccgaacgagctgagctgtttgctggcacctacgacatggtcgttcccgactcttactaccccgagggagactctcgagaacccgtcaagcacctgtttgtcattgatgtgtcggacgaggctatcaagaaggagctgccctctctggctgccgaggctatcagaaaagcccttgatgaggacgatacccccaagaagatcggtatcatcaccttcgaccacgctctgcagttctacaatctgaatgcggatctggagaaaccccatatggtcgtttctaatgatctaaaggacccctttgtgccctttgaggacggtctgtttgtggacgcccaggagtcgcggcatgtgattgaagatctgctcccccggctgcagtccatgtttgagggctacaagtacgccgagtctgcctttggagcagctgtttccactgcccacaaggtgctgtctgcgtttggaggaggaaaggcccatctggttctcggatcaacccctacctggggtcctggaagtgttttccctaacaacctcgaaaatcgaaaaactgcgtccaaggagcccaagaactttgactgcaaggaccctttctacaccgagctggcgggcaagtacgccaaggacggcgtgggtctggatgtgtttgtcatgcccagcagtgtcactgatctggtcactctaggctatatttctgccaagtctggcggaaccaccaagcattacccaaactttgtgcccattcgagacggcaagcggttcatggctgacttggcccactccgtgacttctcttcgagcttgtggagccaagctcaaggtccgatgctccacgggtctgcaggttgccgcctattacggcagcttccactccgacgactggcatattgagcccgatgtgggatctgtcgactccgacagcacttacggcattctgttttcgtacgacggaaagctcgacaccaagctggatgcccactttcagacttcgctgctgtataagcatctggacggtactcgacgtctgcgagttattaacgtgcttgctggagtcaccgagcagttcaagcctgcaattaactttgtcgatgccgatgcttgcttctccatcatggcccgaaacctgttttccaaggtcacctccaccactctcaaggaggctcggtttggtctcaatgagcgactggtggaagtgtttgcctcttaccgaaagaacaccaccgaggttctccctgctacacaactgctcctacccacttctctgcgacctctgctgatccagtctcttgcgctgctcaagtctcctcttctgcgagacactgtgacttctctggacagacgaatccagtacctgcgagaagccaacaacagcgacgtggacaagttttcttacatgctctacccttaccttttcgctctgcataacatgcgagagattgacggaagtgctattgagaacggccattttgttctgcccgattctctggctccctctctggcctctctggaggaaggtggtgcatacatgctcttcaacggcgagaagctttatttatggcttcccagtactgtttctccccagctgcttaacgatctgtttggtgaggacaacaacatcacccgggacctggacccttatatgaactccattcccgaggtcgacagccacatcaacaagcaggttcgagctctagtggcccactttgagggtcttctgggcatcagccatctcaacgttcagctgtgtcgacccaacctggatggtgctgagatggagttccagtctctgctggtggaggaccgaaacatgggcgagtacgcctacacggactttgtgtctcacattcaccgacacgtcaagttgatgatggagaacagcagcatgaagatgactagcaagacgcttttgaatgatgccatcggatacagggaggctggcttgtgatgaagagaaggcagaagaaggtactggtaattcaggtggaggaggaagaaagaacgaggatataatactgttaaaagagtgagttattaggagagggctgtgtatggaatgggtgctgtaggggaggggttgttgacaggacccagtatgatagctaaagtagtcatccatcttccaccgtttctttgtcatccacgatatatcatgatgttgtcatgcacctgaactctatatgtgttgatatatgtaatttgccaaactaaaacttttccattgaacattctttgatctcttgtgaggaggtaagtatgaacgctacggcgcgtgaacacggcttggacgggctttttggacagctactaacccaggcttgtatttttatcccccgtttgtattattatgaactacaacaacgacgattctgaggatcgagtgagtaccaccaccccgcgacactaccagattcaacgacacaaacccacccttcagggacgacgcgtttgagagatggaccgagatggagagaggaggaggatggacgggcctggccttttaccgcgtgctggatgctggatatgggaccaagcaagcggcgagaccatcggcggtgtgatgatggggcgaccggaatggggcgtgcggaaaacaatcaacaaggaggcagaagacgacggtgataatacttgtggggatctactattgggggctggggatggatctacttattttggctgatgactactacttcttgttcgatatgtgatggcaagcgaaaaaaacggcgggcatggcatggcatggcatggcaaggcgcactatctcttttgtgggaggcacccatattacggacgaacacacgaacggctggcgggaaagatggacagcaaaaaaacaaaaggataggctacagagacgcatgtgtgcgtcacatccttcttgttgtttttttggtctcgtgggtatcacatgtccctgtgacggacgggtgcttttgaggcatgtctctcctctctattgtgtgagcgagtgtcctgtcctcgtgtgtgtgggtcttctgtgtgtgtcccgtgatatataggacctctacgtgacatgtcacattagaaggctgttcgatccctgccctcgtcgttttctgctgccattttctgtcgtcgaccattttctatcgtcgacccggccggttgtcttgctcccttgctttccgtgttcggtcacggttgcagcttgggcatgcacaaacgccctctctgtctctccatgcctcctgtcctctcagggctgtcggaaccatagcttcttggttccacacacgtggacagagttcaaggagggttaccctaccctgaaagtgcctcacatgtaaaggcaactctaaagttccaaccaccacaaccagtgcgcaacagcaaagtcattcgtcacagacacaccacaccacaccacccatcggcgacaacttgttacttttctgagctacacgtgcagagctacagttcatcgaattggaagaagggccgtgatattgagagcgagagagagcattgcgctaggcatcaagacgaaaatattcagagtgataattgtggattattagcaccagttttttggcagaaaaataatcacggaaacgcatattgattgaattggctgtgtttggactttagggtatgtctggcaatgagaacgatggctgagaacatgtgacgttctttcaggagaagggaaacaggcaagaatgggaatcgacacatggaaggaagtgcatcaacagcaactactacaacacatggcgtatgaggatggggttgtccaactcgactttggcaactgccacgcccacggcatcgatggcgcaatgcctttgtggcatcaattggttgattgatgtgctcatgtgcttccgaccatgctacctacacctacccctgtttctgtgcaaaactactttttttttccatcccaacaacttaactaactcagtattcccgatcaccctatagaaacagatcccgatcaccagatcagagaaacagatactatcgagaccactccagatctcgatccagaagtaagtcgccccgaagagacttcaacccccagttccgagacagagctggaagcggatcgtaccgacgaaaccgatccccaccaagaagaaatagcggacccccacagatgcttcagcaagtgaaggattcctcccaacaagaccgacgagtctacgttggaaacttggcctacgaggtcaagtggcaccatctcaaggatttcatgcgacaggccggaaacgtgctgtttgccgacgtcctgctcatgcccaacggccggtccaagggctgcggtattgtcgagtactccactcgagaagaggctgagaatgccgtcaacaccctcaccaaccaggagctcatgggccgggttgtctacgttcgagaggaccgagagagcgagcccaagttctctcagcccaacctgggtccccccggagcccgagacggtggccgaagcgagcgaggcggagactttggcggctcccgacagagcggcggtggtgctcccggcacccagctgttcgttggtaacctgccatactccaccggatggcaggatctcaaggacctgttccgagaggctggtcagattgtccgagccgacattatgacctctcacgatggtcgatccaagggctctggtattgtgctgtttgagaccgccgaggacgcccaccgggctatcgagcggttcaacggccaccagatgggcggacgagccattgaagttcgagaggaccgatttgctggtcctcctcgaggcggaccccctgcccgagtggcacgaaccccctttgctcccgcaccacagaaccctccccgggttccctccgagttctcggatggagccattggtggcggcgacccctccgacaccatttttgtgggcaacctgccctggtccaccgccgaccaggatctctacgacctgtttgagaccgtcggcaaggtgaccaaggccgagattcagttcctgcccgatggaaagaaggcaggtagcggagttgttcagtttgagactcctgctagcgccgagatctccatcgccaagttttctggctacaactacggccgacgagatctggagctttcttacgttcgacgaacagagccccagatccccaacgcccctgccgctttccacgaataagcacaaggaactgtttttatgtaatgagttattataggaagagtggagcctccgtgagtggagcgcaagtgaaaatgagttgttattacagagtaggagagactaggtcatgttgcatgcaggctgagataaattgaatatgatgctgtgatcagcgccagtagatgtgtatcggtagttgactgagaaaaaaatatcttaataaaatgtaagactgtgattagactgtgattagagggaggcacttgtctattacttcatctcatggtacaagtacagtaatactgttaccacgttgacatggagcagaatagaagaagatggcttctgagagacccttcttctgggtacaagtaagatacacaactccggtttgctctactctcacacatttagcctccctaatatacattaaatacgttaatcattttgttcccgttacttgggaatgttcaacaccagacctcgactgacttcggtttccttatcggcgtcatcttccccttcgaacttgagccggtacttgtctcgtcgagtccctgttacctctgcccggtaaaaagtggtggtttcggggtaccgtgccagaacctgggaaccagcagtgaactggggcatgtttcgcagctcctcgtctgtgggcagaggaataatgtctctgatggacgtcttgtagctctgtccggggtttccgttctcatcgggctcggggtccttgacctcgaatctctggccatccgagtacactcgggtcacctggcactggatccactcctcttcttcgtctcctcgctgttttcggagtcggaatgcaacctgtgagcccacccgtggaatggggcgtctgtaagaagttgatggtttgtcctcctcgacctttcttcgcttgatcttggagtcttctgggtagtctgttcggaccgcaatcagcacctggagatactcaagagctccatccaggcacttgagacgctccgaaagaacctcggatccagttgtcagcacctcctgcaggtgatccaagctggactcggagggagaggcctctctgaccatgcgcaacatctcgcccaggctggtttgatcgctcagtccgttggtgtcgatcagctttcgctgcaaccgcgaaatgtcggggtccgtctcctgcagggaggttatcgacgtgacgatgtttcgccacgtggctgcttcgtctccctcgggcatcggagtggtgtttgatcgagacctggagtgactgggcatggtttagctagtctgcatactagactgagttatgagtgcttgagcttgttcacatcctccatcgtgagacaatgcatttgtcatgtaccaccctggtgcgtttgtaaagccggtggttgtgaacctgatagatttgaatacacgcctgagtgtgggaatattacgccttttttctacaaagaactcagccatctgttttattagatcaaaaaccctcactgtgcttttttgcacacaagcttcggcaagggatgagcaatgaaacgatgatcttgacagagacaaatggtgtgcaatacttgtagaggtggtgatagagagaatataaggcaaaaggtcacactactgtgcttcttgtccaaaggcagatggtttcctccaacggtgatgctctgctacttctccatgcctgtacttgcactgaagacggtctcatgagttatgtctagttcgttctatactatttacattcacattacaacttatcgccaatgaagtaagccacgaccttgacccaggtcttgacctgtctgtcctcctggtcatagtcagtaatgctctttttggtggtgtatcgttcgatgtggtcaatctcctgctgaagctgtcgcttaagctcctcgtctgtggtgacaatcagagcgttagtctcgagatccttggaatagcctcgtctagtgtagttagaagagcccacaacagtgattgatggcaacttgtctccaggaccattgatccagatacccttggcgtggtaagaccatccaccgggggtgttgacgacacctcgctgccactccagcagctcaatctccttctgtctatgggccttgttgacgtcaagaatgaactggcgcgccagcagggtgtagcagtcgggcaagtactgcgagataccgtgactcttgtaaaaaccgttggcttgaggagaggcagtgatgacggttcccttatcggggacactgccgagcagcttggccttgaattcggggtgcatgttgaagtagccagcggtgaaggtccatgaagatcgctgcatggacagcatggagagaagacgtcccagagtagggaactcggtggaggaatcgggtttaagaaggggagtgaattgcgagatggggaatacgagagtctggggctcggtggactctgactcgttcttagcctcctcgagttcagtttctctttgggctagagacttgacctttcgtcggccgctctcgacaggtttactggtgatgagaggagcaatagaggcggtagcctgacgctggaactcggcaagagacacattggggctttgcagagtgttgttgttgggccattccagcacaaagccggggtccttgaccggttcgggttcgggaagaatcttcttggcaatagaagcagcctgctttttgaagaagacagccatttttccgggctcgggggccttctcggcgggtttggggagggccactctccagctgagtctgcacacagcgttgtggatggcgtggtagtagtcgacaataggccgagacttgaacacaaagtatcgatcctgtcggttggtaaagtagtctctggacaggttggctcccgacagaatgatatcgtcgtcgcaaccatacaatttcatgtgttgtaggccccagccttcgttgaatcgcttggggatcagctgtttcttgagtccaaacaggtgtggggtgatgtagcatctgatatcgacccgatctccgtgtttgtggagcagggaggccagaagagaggccgagcacgtttcgggctcctcgcgggttcctctcaggccgtcaatgagcacggagaccttgagaccggggtttttcgtcagagcctcgtccaagcagctaactagttccgtctcctccttgccaacgtaaagagtggagaggaacacacgctccttcgccgccaggattttctgcttgagctggtcgtagaactcttcgggatcgtacagaacctggatctggcccttgtccacggcaaacttgggcactgtggcttcaatctgcttgagagtgatgttgacgttactgtggagaccagagagtcctcgggatccgccggtgagtcgcatggctcgcgaagttcgggcactcaccacgcctgctcgtcgagctgagcataccaatccagccaatcgggcgtttcgaaacatgtgttctgctgttttcacaagtacgatactgttggtcggggtcgttagtcgggatatttcaaaactgctgaagtttatccatacatgcggagattagtatggggtaggaggagtgtagctgatattgaaggcaaaagacattttgaccgagcaatcaagtgactatgcacttgagatcagattgttcaaaaaagcaatactgtgcggtcattgttggccattgtttgttcgtcatacttgccttattgtatccgagcgttgcggctcatcaacataccagtacaggctacagcatcgctcaaacaccaactatgaatactattcctatgtacaatgcacccgtttagactcgtcgtcgtccaggaggtcgggtacctccctggttgagcttggttcggtcagacagacggtcgaccttggaggccaccttctctccctcaggggcagtgagagcggcaaagaaaccctctcggcctcgtccaaagcctcggacaacaacctcgacgggtcgggtcagcatgcccttcttctcgagcagctcaaaggctcggacactggtctggaaggctccatcgtactctcctcgctccttcttcttaatgccgagatgtccgcaagaaatgtggaatcgcacctcctggggggctcgcaccttctgcagcagcttctcgtcaatgctctcgggaatgaaggacttgtcaacaaactcgtcggtagcgcagatgtgcaagttgttcttggtagcggtcacatggacgtagtgtcgcaccacctccttacccttggcgctctggtcgatctgtctctgggtctctcgggccttgttcagctcctcggcgtccgtcttagggatcttgctgatttccttttgcactgtgttagtacgatccggagtcgttccatcttggtcagatcctcaaatcagcctgctcgcaagcgctcaactcacggttcatgaaactggcgaggccagaattgtgtcgaacacctccgatggcgcccgtggcgactcgggtccgcagcatctgaaacccttgcatttttgtgttagtgatgacgctgtggtggtggatatgcgtaaccttgacaaatttgattttccacccggcacgtgatgcacttagtcagtgggaggagtgtgcggtgataaaaccaaaacaaattggataaaaccgccataaatatatagaaaattaaaagaaagaaaaaagccattctaattgactgtgtattaaagaggggaaccatttattttgcaatcgcctatccacacaaatcagctaaatcaactaaattaactaatcaaagtctctcatacatactgaagaccacagttcaagcttaaaatggtgacgagacgctgaacacttgaaaaaagtacatactgaaaaagggttggagtaaagtaagtaaaggcaaccctcgactgttccctcgactgttccctctctggctcctctctctgttggtgttccatctcatctaacccatagtttcagctcacgatatgacctcagttgtactggtacagtatgtacatacatatacgtacttgtagagaatgtacatgctcatcatactctgatacgtttgaaactccatacctatataaccaacgtcaattcgctacttgtacggagtggtaaatgaactacttgctccttgttcctgcttcacttatgtggctgtcatatcataccattctcacaaaaaacttccagcaaaaaagtcgtacttgtgcttactggactctgctgttggaaataatcgttggaggttaattatattttcacacgaagactaatattgctgacgagcaacgtcccctcgtaatagctacagtgttggccaaaagccaaatggatagagtatatggggatccgagggggccagggaaccgccttagttgtcaccgggtggcctctgcaccgcaattagccgccagtcgcgtggctcgcctaaaaaagatgtatttagaccgggatccagcgatggagttagacgcacccacgtggattgcgtgcgcttatcgctatgcaagggagcaacagagaaagagtgtggcctactttggaggagagcgtgtgaaaaattgacacacacgacacaaagtacagtcactctgcacattgccattcagcccgaatcatgacgcaacaggaacgagaagccacccgagccatccgcaccaccaaggcgccctacaagccgtggattagctcgcccaacgtgggtctgtcttttgcctaccacctgattggcttcatctcattcgcctcgtcgttccactttctggaacagtaccccaacccgctcaatgcctcgtacggaggaaagtaccagtacctgaccattctgggtctgtgcggcagctacctagcgttcttgcttgctctgctggccgacgcagcctcgctctactccaaggacttcagcaatctgctttaccagctcaaaaactccgtgtcggtggctgtgacgcccctcgagtgcgtcatcaccgtgctctactggtccctcaagctctacgaccccaagctgctcaaacaccccgccgtcaaggaacagattccgttgtggctcgacatgtccatccacctggtccctgccgtcgcccttttcctggacgtggtactcatgggccagccctggaacctgaccaccgtccaggccgtagttgccaactttggtctgtcggcagcatactggttctgggtccacaagaccgcctccgtcaacaacttcttcccctaccccttcctcggcctcgtgagcaccgaggtccgagttggcgtcttcattggagccggggttattggctacattagctatatcatcatccggggtctgcagtcgacttttgcccgatctcccctcgaccagctcaagggcaaaaagagcatctaatcagtcttagtgcttgtaaatagaatatagaaacgaagagtatcaaaccaagaggggtaggggctacgagtagccaattagtacagtataacaaaatactcgtacaaatacaattcaatgcgattaagagttatgtaagtatgcaataaatagtggggtggtcaacgttccgaccaaatgtactcgacaaaggccatgacatcttcacaccgaagactcacctgagcagtgctgtttccaagactcagaggcgcaaaatagatcttgttggtggcccgatcaatcatggcaatggcatcaagcaacatgcgtcctcctcccatgggatgaagtgcccgaaaagctcgcgcaagggcaactgtatggtcacagatgaggggaatagaatagtcgttctgtgtagcatgggcgtcggtagtcacggcaactacagtagcacctagctgtgtttgtagaaccgcccaacacttttccagctgctgtcggatattgggctccatctggtcgtccaggaagaacagaaagccgagctcactggaaatgtcccgtagcttgagtattgtcgtatcgctgtccatcacatcgctatgtggaccaaaataccctacttcgcattcaaatgtaagaggaacctgtcgaatgctgtataccgacccttgactgatataccgagggatctgggtggtgcaagcatgggtccgtcgctggctgtggcccttcagacgctttgtgatctccttgacgttttcccccgagagaacaacctcatcctcctcaacttcgtctcgaactcgtcgtcgtggagtcggtgtggcggtcccgctacagctcttgcgagtaggtgtgcgaggctgtcttggtatgatgttcatgttgttggatgtgtgtgtgtgtctgagtctgtgtgtgtggatgcagagtatttaaatgattgctttgtgcacgtcttgttcttcttttttctctcccgactctttgtgtttgacccctcactgtttgttttagtcaccggtgatccagggtccagactagttctcacctcccctcccaggatcaccttgatacttaagcatgcaacctcgaggatgtctattctttgtttgtgaattgcccgtttcggtaatttcaaaacaaccctaaccctgtccccacagtccatcaagggatagccatgcatcgaacgcagccccgacgacatgaaagttgggcaagacaatggcgtcaccaagacatgtgggtcacgtcataccccgccgcagtaatcattaatgcacgagcgctattggtgtggccagcttactaatattacatctacaacaggtacactctctgtttatcgcaaatacgtttaaatagctatatacttagccgactggactctatcatttcaaaggcaaagttttagatcctagctagaatggttagtgatcgtgtagttcaaatgggggaaagatcagtaggaaggcactttgtgcgcttccctgatgcgtgatgtatacttacttggcaggaggagggttaacaatgaactcctcgcccttggcaatgttgccgtaaagaccgtcgatggagaccttgagaagcttcttctcgtagtcgttggcctcgggaaggatgttgtaagccttagcggcaccctcagggccgaactcgacagggacagagaagaaggcgacaccgacctctcgcttgatgtcggaggtgccatcaataccgtcaaggtagatgtaggcgggctcgatgatgcccttctcaccagcggcacccttgaggacagcctcggcaaatcggaaaccagcctgggccatggagagggtagcggatccaagaccgtccttagcctggacaacctcgtcaccaccaaactggattcgcttgacgaggtcgtcgagcttgtcggcggggatctcgaccttaggcttggtcagagacaggagagggacaatggtgtctccggagtggccaccaacgacggggatgttgagcttggtggggtcagactcgccaacaacagcggcggtgaaggtctgggctcggacaacgtcaagggtggtgacaccgaagagcttcttagggttgaagacgttgtgcttcttgaggacctcggcagcaatagggacggtagagttgacggggttggagatgatgagcacaaaggcgtcaggggcgtactgggcgacaccggtgacgagatctcggacgataccagcgttgatcttgaacagatcgtctcgggtcataccgggctttcgggggataccggcggggataacgacaatgttggcgccggtcagagcgttcttgagaccgtcatccttggggaggtagccagtgaccttagccttggtggagatgtgggagaggtcagcggcaacaccgggggagttgacgacatcgtagagagcaagctcggtcacgtaaggagagagtttgaggagaagagaaaggggctggccaataccaccagcggctccggcaacgacagctttaaccactgagttagtttcgagagttcatgatacaaagacatcgccggttgtgcggaagcggggaacaaggtagggataataatccgcagcggcattggcgatggcgacagcgatggcaacagcgatggcaatgcgcgcaaagagatcttgcattgtgtcgggtttttcaattgacgattgcacaacatccagctgtgtttcgtgaggtaattgacccttttgatagcaacgcctcagaaccacgatccatgtgcagcgactgcagtctgccttcactggccctgtgcatgccattgttgcctgttcaactccccgagcaatcaattgactcccaccatgatactcacttttgaatttgttagtgttttgatatgtgaagaacggtgcgaaggaacacgtctgtctatatatactgcaccctgtgttgggatgatgcgtgtgctgaggtcccacacacataataaccatataaccttgtctctagccccgggttctgagagacggggccgcggaagaaggcatcgatacaagagtcttgtggtgggtcttggtctgctcaattgctctcgaattgtctataaataccccccaggacgccctgttttctcgccctcacactacacgccttgtccacgtctctcctcaactacccagcaaattgctcggctcttcggtcagtgctggctaaacccaaatttccaagctctgtgcggggtgcacatgataatggcgtgctattggctgaggcaggtggagaaagccaaggtctgacggctgccccaaaccgctggtccgtgtttttccgccgcttgagccgcctcaacacatgctacaagacgctactacaacccccccaccgccgacgctcggcacccacttgcttcgggcaaatcacactctcggaacagtccggaatatgcacgtagctgccacgataatgtttccggctagccatggaacggggtagaaatgtggagagatgtggttgagccctggccacggatcgtgctggtactcgtgctcgtacgcgtcttggttgtcttttccgggccgcaagaccaattgttgtacaccattccgcttgcattcagccgcacggcttgtctatataagtcctcccgcctgctagcatcaattggtcttgtcctgtatatgctattgcgccatgatcgacaaatctggggagtcttgcaactggcaacagaagggaaggctgccccaaccgtatgacgtgggccgaatcgtaaatcatcttgggctactgtacattcagtaccttatccgttgtctcactcggattgcgtcatagtattggagtgcggtacttgtacgagtactgtacccgtacgagtactcgtgatatcgatcgctcgtggtatcgtaaggtaacagtttgcaagagacggaattggtcaatatgatgcattgttgcttatactacgctggtgctacaagtaccgttcattgtacaccgtatcataggattctcatggtcataacctgtatacccccttcaatcaccttcaatcgatgttacagacttccaagacgcgaatattcctttttcttggtgttacattaggcacctctgatcactttgcgtgcacctttcctggcgtctgactcctctcaaatcaccattattattcaacagtgacttcaagtcaacggtttaggttgagataatgcagggccggagttgttgacgggaaatcaatggaaaatggagcaagggtgcacgtgctttggttttgctattaatcagtacttgtagtcgagaccatgatatgacacgattggccgttgtttgattattaagcatctcgacacttcttcagcgttgggtgttcaggtaagagccccccaagaacgaactcgtagaatcacacacgtgacttggatgtccttttgatcgtctacttggatgcccattcaatatcccggggtgaggctatgaagcatcggtgtacaatgtgctcttagattgtctgtcggtaaaatgaagagtgtctacagtatgtatatactcacgctctcaatctgttatcgttaaatatagcagtcactttcccagctcattcaacctctctcagtgtcagcatttctgtctactcgtcatcttccccatgtcgtgtctactctagttgctacacatctcaggcagtgcaatatcagtgaatgcctcactccaatacattatttttttaccatacttcaactaggtgataatttaggcacggtttcgggcagcaaactgcttcttggaaacagtggcggctcgcttgatggcagaagctcggacaatggcgtcgtagatctgctcgtccttgtagccctggacggtcttggagacggccttggcgatagctcgagaagacttggtgggcttgaactcaacaatgtgtcgggacttggcgggcttgttggcgttcttgaccaccttggtgatgacgcagatcttgccggagggcttgcagtagtgcacaccgacagccttgtcgtgagagagaccggactcgtagtgagtggacaggttgttgagagcgtaggggtctcgagacagagtggtgtcgatgccctttcgcttaacgaggtaagcgttggtgctcttggtgcactcccagatgaaatcgttagagacgttggtcatttttgagctgtggtgtgatgcgactacaaagtagggtgcgaagatttgggtgattgaaaatgtcgagagtctgtgcgcgaggtgtgcgccccgattgggaaggaggacctggagctgcggccgggaggaagtttactcccgggtaagtcatgtgacgtgcgtgggaagatttttcggctttgtgggttcgattccgacaaaacacctctaaatctaaattaattcgattcgatactttttcttcatctggatggatctgcgtccgacaaatctgtgcgctgccgaaagaggcatattgaaaaattgatttgaaggaagcacaagtggaaggacggacattttccagcgtgagtgaaataacggctcatacatcctggtatatgcactccttcatactcttcttgtactagctcgtgttatacctcccccttcccctaataatagccgcctatccagatatactgggggcctgtcagcacccaccaataagagatcggttgactccatgtcggagaccattcccgtggtgttttttttccggctgcttttgcatcaatggcgcgtcagggaggtccatctcgtgagtttgtggctggcggattccgataagatgaaaaatgacggtggtttttttttatttttcttcctcattcaccagtgctgcgctacaagtagcagtaagttggtgtgtttgtgtgagttggtgtgactgaaaagatcgccgtggacataatgtgagtcacgattgccacccgtgtcatgactctgtcactctctcgtctgtctcactcatgtatggatgaccattcatcattacggcgcttgtcaacacctcctataagggacaggttagagataactgaaagctaaaaagctaaagtgccattaatttcgcttttgccatcttcccacaagccttgtctggcagacgaccgaggtgcgaaacggggtcaatgttagacgaatggaggtgggaaaaagccgagaagaagacgaaaatcacacaaacagtgtggacacaagacgctcctgttaacggaattgctatacatccccgccctcgcttgtttgctgcatcatgggtgcgagctagtgcgtgtttaatagactcattctttgcaatgcgcacggcactgcattgtatgcagccccaccccccccgagcgagtggtgtttggtagatagacacactgtgtataaaatgtgggggtttcgcaggtgacagcttttccacattcgcgcctctcgtcaacccgctgctcgaacaagttgtgttgtgctgagacatcagtcttaagtgccagagttccttgtccttaaaaagataccgtatttactacacgttcctttatcagcgtttaattttcgcaccaaccttttggtttctaactttttcaacttcaccaccatcgctcctctccaccaacagtccacccaccaacatcatccatgtcattgagctgcgaaagtcccctgtgggatggcagcgatgtgccccggtgtagtcgccaaatgtgagtattgtgcgggatcactacacaaatatgaatatgaaccaatccccaatacttgtacacaccactaacaccagatacttcttcttctatccctatgtcatcaccatcgccatctcggtgctcctactggtcacccgaacgatccccgcctcgataaaatacctcgcacgacagtcccgaaaacgagacccctcggctaaaccccttctcgcctccgaaacctttgtggactccgataccgacgatagtgataacctacagcccgtggcgtcggaaacgtatggagccgtgcttgttaacacccagcagcgtcgattttctgtgcgagcagaccgagcccgactctacggaggccagaacccttcctccaaggatgacacctcctacactgtgtgccaccgaggagtgtttggaaacctgactttcgcgctggagggcgtctgtgtcattgcccagctggttctggctacccttcccttcaccattcgagagctctaccccgtttacgagggctacccttacaacgtgcttgtcaacatggccttctggcttctggccgtgtctctgtacgccgctcgagtctgtgccaactggtccaagtttctgggagctcaaaagttgtggctgcactccactctgctatacaccgtggccgtcatcagctcggccgttttcttccgatccgccattgtcgacccccagaccccaatgtccaagaacttctttgtggcccaatttgccttctgctctgtacttttcctcatttccatcacagcaacctacgctgataagcctatcgttctgactgccgtcaagggtttgcagccctctcccgaggccattgccagcattttgtcccgatccaccttcggatggcttgatcccatggtgtacgccggatacaagcgaacccttgatctcaaggatgtctgggacctgcgatctgacgaccatgctgtggccattctcaaggacttccgaaagctcaagcgaacggctggactcatctggagattcaccttcttcttcaagggctatctgtgggcctcttctatgtgggcaattttctactcgctggtcaccttcatccccactgtgctgctcaagtcgctcctgtcgtatgtggatgatccctcaggcacccccaagaacgtggcttggctgtacgtcattggcatgctgttggcctccattctcaacaacgttggccagggccagtgtcttttcattggccgacgaatctgcgtgcgaatgcgatccgtcatcattggagaaatctactccaaggccatgcgacgaaaggtctctgctgccgagactaaggagaagcccgatgagccaatctctggtgaagccgaggttgacgcgctcgcagaagaaaacaacggagagggaccacagcaggccaacctgggagccattatcaacctgatggccgttgacgccttcaaggtctccgaggtttgtgcctacctgcacttctttgttgcctccattgtactctttgccgtgtccatctggctgctgtttgtgcttattggctggtctgctcttgccggctcgctcgtcatgttgctcttcatgcctgccaactacctcttctctgctcaattctctgctgtccagaaagatctcatgggtgtcaccgatatccgaatcgagaagaccaacgaactgctgcagtcgattcgaatcatcaagttctttgcctgggaagacaagttcattgacggtgtcaatgaggttcgagagaaggagctcaagctgctgcgacgacgagccatcacctgggctggtgccggtctcttctggtacatggccccctccctggtcaccgttgcctcctttggtgtctacacctctgtgctaggccacaagctgacctctcctatcgccttcacggccctgtctctgttcaacatcatgcgaatccccatggcccagttcaccgagatgcttgctgccgttttgcagtccaaggtgtccattgaccgagtcgagaagttcctgtccgaagacgagacctccaagtacgtgcagctatgcaaccccgttcgaggtcccaactccccctacattggtttcgagaacgctaccgtttcttggggcaagaaggagtccgacttcaagctgcgagacctcaacctgtccttcaaggtcggccagctcaacctcgttattggtcccaccggctctggaaagacctctcttctgcttggactgctcggagagatggagcttgagcagggccaggtcttcctgcctggtgctgagcctcgagaacagctcgccatcgatccttccactggcttcaccgagtctgtcgcctattgcccccagcaggcttggttgctcaacgacactgtccgaaacaacattctcttctcttctgagtacgagcccacccgataccaggcggtagtcaaggcatgtggtctggagcgagacttcgagattttggaggctggagattccaccgaggtcggagagaagggtatcactctgtctggaggccagaagcagcgtatctcgctggctcgagctctctacacccgtgctcgacacgtgattctcgatgactgtctttctgctgttgactcccacactgctgcctggatctacgagcactgcatcactggtgagtacatggccaaccgaacctgtattcttgtctcccataacgttgctctgaccatcaccaacgccgacaaggtgatcatcattgaaaatggacgaatcaagggcgctggaactccgcaggagatggccgaccagggtcttcttggagacgacaagcacattctgtcctcagcatctgtctccgcttctaagaacgcttcccacgtgaaccttcccgatgctgctgaggctgctgccgctgatgccgaatctgatctgctgaccaaggttgcctctcgaatcgccgaagagactccttctggagctggaaagctcacccaggaggaggcccgatccgagggaaccgtgccctggtccgtctacgagggatacatggccaacatgggtggtctcattttctggggtggtctgaccattgcctttgtggcctctcaatcagctgaaatgtaccagtctttctggatccgacagtgggcaattggtgttggtacccccggcgacggtgtggagcccggaactcttctttctgtcgccaaggttgtccagtcttctcccgttctgcagtctctctctgtcttctaccacaatgttacctccaactttgtcaatgttgaggacgagacccacgccgctcactcggctggctactacctgaccatctactttattctggctgttgtctttgttttcctgtctgtttccaaggagctgtacattttctttggaggtttgcgggcttctcgaaagctgtttaacgagctcatgcagaaggttgtctatgccaagctgcgattctttgactccactccaattggccgaatcatgaaccgattctccaaggacgtggaggctctggatcaggaaactgccatggccgcaggaatgatggtccagaactttttggcttgcctggccactgtggttcttatcaccatgatcacaccttccttcctgttctttggtatcatcattgccggcatctacctggccattggtatcttctacctgaccacatctcgagagctcaagcgcctggactccaccacaaagtctcctatctaccagcactttggagagactttggttggtgtgactaccatccgagcctacggagatgagccacgatttgtacgagataatctggagaaggtcgacaccaacaaccgacctttcttctacctgtgggttgccaaccgatggctgtctttccgagttgatcttgctggtgctctcgtcaccttcttcgctggtgcttccattctcatggccattggcaagattgattctggcctcgcaggtgtgtctctcacctacgccatcctcttctctgagaatgtgctgtgggctgtgcgactctatgccgtcaacgagatgaacatgaactctgtcgagcgaatccaggagtatcttgatctggaccaggagcccccggccgtcattgaggactctcgacctcctgccaactggccctcaaagggagagattgaagtcaacaacctgtccctcaaatacgctcctgaggtgcctgatgtcatcaaggacgttactttccacgtccagccgcagtccaaggtcggtattgtcggccgaaccggagccggtaagtccaccatcatcaccgccttcttccgactcattgaggcccaccagggtagcattaagattgacggcgtggacattggcaagattggtctcaaggacctgcgacgaggcctggccattatcccccaggaccccactctcttcacgggaaccatccgaaccaacctggacccctttgaccagtacacagacgaacaggtatttgaggcgcttcgacgggtgcatttgatcgaggactcctccagctccgagtctgacggtagcagctcttctgctgtcgctactaacgaaaacaagaaccagttcaaggacttgtcttctgctgtcactgagtctggatccaacctgtctcagggtcagcgacagctcatgtgtctagctcgatcgcttctcaagagccccaaggttattcttctggacgaggctactgcatccatcgactacgagacggacgccaagatccagaagaccatccgatcggagctcaacgacaccaccattctcaccattgcccaccgtctccgatccattatcgactatgatcagattctggttctggacgctggcgaggtccgagaatatgctcctccccacgagcttttgcaggacaaggacggagtcttctactctctgtgtgccgactctggcgagtttgaggctctcattgacttggctaaggaagcctacgaaaaagcatagcatgataatcagcagacctgatttagtttattagatttttaacattgaaagagattgtattgtagtggcgtatttctggggcaatacgtacaactacagtagtcattcaaatttgatccagacggtgtgatttctaggattgaaatgtgtgaaaaatctaactgggtttattaggtagcaaaaacgctccctaccgccttgagattgaaaaaaagaaattgcagcacctaggattctcgtatggtctcccactacaatactaactaggctctctggtgcttgactatggctgatcggacgggaagccgtattttcaccaggatatggccgcaactaatttcataaacgtaatatggatcataccgaatcattagaataaaaaaaaggcttagcgtgaggagaggtacgctggcgggcccaagtttggtttcttgtgggcttcgtcatttgcaggatcattagacgacggaggatgacaagcgggttgtcttccaagatcctctcgtcaggggcacttcttcgtggctggagatttggacaagttgagatattctctagagaccaagctcattttcacaatggactaaagtcctttggagatacgtgccacataattgaaacaccgtacattctgtacgctaggggatatgagcttctaatatatcttgcaaattctagtagtcaattgcttataagttaaacagctaaagtgcttatttggaaacgtgggccttgtgctccttgtcgtcaccgtaagccttagtgccgtagtggccgttgatacagatgacatcctgaggtcggtagttctgctttccggagaagtagacctcgagaatgttcttggtaccctcggagtatcggccctgggcatcgatggaggtaccggagatatggggggtcatggcgtttccaccgccccacttgtttcgcatgtatctccaggggtggtccttgggggcaggctgggggttccagacatcaccaccgtagcctcggatcttaccggacttgagggcctcaacaatgtcgtcagtgacacagatggcacctcgggcggtgttgacgagccaagcaccatccttcatgtgggagatgagttccttgttgaacatacccttggtagagtcgtggagaggacagttgatggtaacaatgtcacagacagagagcatctccttaagatcagggacgtgtcggcagccaatctccttctccacgtccttgggcatgggctggtagtcgtagtagaggagctccatggggttgaagggtgcaagtcgcttcaggactcgctgaccaattcggccaccgccgacagtaccaatgaccttaccctcaatgtcgtaagagtccttggcgacagcagcgacattccagccaccctcgatgatctgctcgtgggcggggacgaagtttcggaccagaaccagcatggtcatgacaacgtgctcagcgacggactggacgttagatccggtaacctcgaggacggcaatgtctcgggcgttggcggcatcaaggtcgacatggtcggaaccaacaccggcagtgatacagatcttgagcttcttggccttgtcaattcgctccttggtgatgtaagcggggtggaagggggtggtgataacaatctcagcatccacaatctccttgtcgacggttgagttctcaccgtccttgtcggaggtggtcaccaaggtgtgtccctgggactcgatccagtcacggagaccaagctcgttctcggtacatccgagaagtcgaggctcatccttggcgtgggaaccggcgtcgtagagaacaagaaggatcttcatattgtagttgtttgttgtttgttgtttggtaaggagcgatagggggacatggccacccctttatatatcttctgagctcacacggttaccacctcaacccttataccccatccgcccgcacaaccttgaggctcagtgtgtaactgccttgtctgaagcttcggtggctgatcgagcaactggggcagctggctattgggggagagttgtggccctcagagattgggttggggctgacaggcggaatgttctgtgcctcgctaaggtaaggaagctgcttaagcgaatatggggtgtctcatggacagcaattcaatggcgtccagaaatctccaaaaagacggcatcaattgacctagtagttgattgggaaccacaccaattccccgaaggcttcaccatccacgtttttccatatccaactctcccctcaaacacaaacccagagctacaagtagccatttccgagccgcaaaagccgacttgcaccggatacacaaagataatggagccaaatccgaatatctcgccgcaccgcacggtccggcttctgtttgtcctttcagcggggtattggaacatggggtatgatccggtggctccagcgaggcggcttcttggacgtggatcctatacatacggtggcagaccggcttcagaatacagctcaaactacactatctcacgccgtctgcatggcacgattacgtcgatatacgtgtgtggtacgcactggaagccctttcctcgatcacgccccctccccaaggtttagttgctgctacgagcgcctgccattggagaggagggtgtacagccctgatgagtgcctgggttatgcgcggtattattgacgataattatatgagaaagaggtacatccgatgctcggaagcacagctctcaacaagtgaatctgtcgctacagtaccagtagatatgccaagagtgcgtaggtttcatacacattggtgtatcgtttggctcttgtcaaacaagtctcgtatccaactaccagcaataggtgttatttatgatttgtccgtggaccacctagcacccctgctccatacacccttccatagcaccccccaatcaacacccatagtgtacatcttccagcaatgtaaccgctgctgcacttggcaaaccttgcacacacatcctcggggacgcaaaagagcacaagccggaagtttgagcgaatatcgacttcttcggatgtacaattgacccttcggattcggctcctgcaactttcctcgccctaatcaggcgcttatagctatttcatctgtgttaccaacaatcaccaacctccaaggcagctactctatcccccccaaagttccatcttctgtgaggaagttagaaggttatcgtctcggccaactcataggtggtgccttgactccaaagcctggttatggaaggccatggatgtctcattggattcccacaacctgcagagtttgatcaacggcgttgcctctgctggaaattggcgccaaaacgtgtccccccggcgccttatccgggagactcactctcgctataggagatgtcttaacacaatcaagattcagaacaaaaaaattcgtttcgtgcataattgtgcaaaaaaatcgacaactgcaggattcgaacctgcgcgggcaaagcccaacagatagtacgttaattcgaatctgtcccgttaaccactccggcaagttgccactgggccacgaatcgcggcgttgagtcttgagactctagagcatactagagccccaaaatagcgaaatttaccacgacattttgggcgtttagggctattctaaaagctcatgggaagaaccaaattagcaaacttgtaaatacaggtggaaatttatattcgaggtagaaacaacttgaattggtgtaccatttagtaaatgctgactaagcgttgttatgtagggagtgtgtctcttttgaggttcatgaggtactgccagtgggttattgctgagcttgtataataatcacttgtgtgtataaatgtcatcatcattatataattaatactcctatagcttcgggggcttgttgccctgcacaatgacagtctccgggtaagtagttcgggcagaagtgtgccatgctgctccgtcaatgacaagagtggtacctgagatgtatgaggccgcatcagagaagagaaacacggttccgttggcaatgtcctctgtggttccaaatctctgcacgggcacaagctgcagagatcgcttccgagcatccgaaggaagcagacgtccgagaccttcggtgccgtcaataggaccaggagccagacaattgacagcgatgccgagaggccctagctccacggctagagcctgcgaaagtgcgtcgatacctgcctttgctgctgacacgtgtgactgcagcgagactcctctgtagtgcagcgtagcagacacgaatagcaccttacccttgttctttctcagctcggggaaacatgccttgacggtattgtaggagcccaacagatcgattgagatgacggacttgaaggcgttggcagacaggtgattgaagtcagccaggaagttgcctgcggctcctgcaattacgtagtcaattcgacccagctcctgcacagccttctcggccgccgccaccagcgacttgacttctcgcacgtcacagttgccaattccaattaccttggcaccaggacgcagctgctgcatctcctccgcggccttttgtgtcacttctggtcgtcgtccgatcacggcagcgttggcacccagcagaatgagagcttcggtttgcactcgacaaatggtgcctgctcctccggtcacaaacacaaccttgccatcaaacaggccggggttgtagacgcaggtcttgagccattcgggagtaagagtgttgggcatgttgaaatttgacacgcaataagttgacagcgtcaagtcaaggactgctccttatatttgtactgtctcagcaacaaggttcaagtggggtcgaagttaggtggggggttgcaatacttgtacatagaacgatatatgggaatatgtctggtacctcggtagaatgagaccgtttgggggggtccctgggggtgtgttctagggtaagacattctgatcatgcgcttaggtaatacatacccatccaattgcgcgagatatatctatgtatatacacctgacttagctctcttacaggagatgtttcacattcccttgcaacccggaaatacagtgcctgtatcacggattcagccacacacatacaaaaaaccacacacacctaccatctacaatgccaattgcacacacaccgattctctactcatctttgtacagtaatctcaccctacccaccccacctcggacccgaccatgcatcacactgcagcttacacgcacacccgctgccggctataccactaactgcgccagctgggtccaaatgtcataatcataacgaaataaataatacctacaatacactacatgttgacggccaaaagaatggccaacatacccaaagtctcccgtccatctgcaatgggtattttaagcagctccaaaatcatctggatgtccttgttgagcagcaacacggcatactcgaaacgatactgtaacgacgaggggaacagagggaacgcacgcgatccggtgatcacgctcaccgggtcaaagatggcatgatgagcgcccacacgtgtgatgggatacttcagcggaatctcaaacaacccagaaaggagcatcagaagctcgcaagtaagagaatatgcaaatgtctgctcgtgttcgtcgggggaggttagtgataggccggcaattgcgtacgagccattcctatgagtgataggaaagatttcacaaagttgttgaagagcctgtttcctgatatcgaaaagagctcgcttttcgtcctgaacttgcttgtgcagatccgtaggtacatcctgtagcgcctccctagccttatcttgcagcatttccccgctcctcaagtacgcacgcctcgtttctatgtcctgcacgagctttgcccttttttggtccaacttgaacttcgtggtggccaattctgcctgggcttcctttatccgggctatttcagcagtggtgtagttctgactacgttcagccatggtcatcagctcccgattccgcgtcagagtttctacctccttcgagattgtctgtcgggtgtgttcggcgtccttcacaagatgttccatattgagcaccttgagcatctggtcaaatgacgtggcattcaagggctctgcgggtgtgcgtaacccagacgaagaagacacctggtgtagaaaggccgagggagttcccggagtgaaacaaccgtcgtcaagggacaggactagttggctctgccgacgggctgttgattcatcctggccaatgtatcgtaaagacgacaaatcgactcgatataccgagggccggaacagctctgcgtcgtcgctgtcctcgagccacagaaccaccacgatctcctttaaatctctgtagtttttgtcaaagtccaggtccgcgccaaagttcgactcgtgcacaaacaaggacgatacgtagatgggctcgtctttatgttctgggtcgtggattgagaagaatgcggtgggtgggtggtattccatgagttcgtcgttcagtgagtctgtgctgggtccccgagaaatctcgacttcgggagttggcgcgggacactccgtgacgctggtgatagttggggccggcatgagttctttgccgttcgttttaggctccgtagtctcgtcatgaactccgttttcgggctctgactcgcccttggttgtgatggaaacattggtcgacgtggcctttttggcagtcacaaacggcaaaaagcctttttgagaaacgcggaattgagagtcgtggttagtgatgaagggcgacgctggccgggtcggaggggtgtccaggggcgtggcgagcgccgaagagatgcttttgaggtcgtttttgccgcgcacacaaaccacattggcgaaggaaaggcgatggacgtggcgaagccggcgcttggacgacgctagagtcagtttgtgtctgtctctatgtcccatcgctgtggttttcaaaatcgacgtaggggtgatgacagtacaagtttaccctcaccatgcatacgacgatttagctgcgtttgtgatgaatgcgacaacctaagtaaagtgccttagagttagttaaggctagataagtaaatgtgaatcaagggggatgcacattatagcgtcaatacgaacgacataaggctgaaagttggaaaaattgaaattccctagtgacgagattatatgtacaagaatcagccacgtctattggaaaaatcagctgcatttgagtgaggttggaagacaaggctgaagacataagataacgcgcgatacaccctctatcagcttcaatggtgaactgaatgggctgtaacgaagatatatatatcactcttccagctcaattgatattccatatatcaattgatgccttatttatacctttggcatccatacttgccccctatctacacatctccatgtcatcaactcaaatctatcatcattggtgtacctatacaaaattccatcatcgcaatcaacgccaatgtcaacgtctacttgaaagccttggcgacagtctcccagaactgcttaccctggattcgggccacgttcttctcgagctcggtgggctttcgagatccgtctcctccagcaaaagtaccagcgccccaaggcgagcctccgtggatctcgtcgaaggaagtgagcagaggggcggcctccttgtatccgaggggcacgtagatcatgccgtggtgggcaatggtggagagagcgttgatggcggtggtctcctggcctcctccgggggtaccagtggacacaaagacaccggcgtacttgccggccagtcctccgctggcaaagagacctccagtctggtcccagaacgatctccactgggcaggctggttaccgaatcgagtggggatacccataaggataccatcgtactcggtgatcttctcgggggtgatgacggggtcatcggccttggggggagctttaatgatgtcgagaactttctggggaagggtctcctggacttggtagagggtggacgagcctccagccgacttgataccttgctggatctcgtgggcgagggttcgaatgtgtccgtagacggagtagtagacgacagcgaccttgggagccattgtttttgagtagttggagaagcgagagacgacggggatcaaagtcgggggaggttatacctctatatatatatctgtcttcacagccttccgttttgagtcaacgcaaatcggtggtcgtcacggctgtagtcaatcttgactgtgcgtgtattgtgcatcctacagtaggacaaagaaagagaagccaccaaagacacgatccagcgatagaatttgcaccataaacctctgctattgtttgctcatacatgagtagtgaaagtggggtgtgtactgtacttgtatctggcgttgtactactacttgtagtagttcaatcaagtgggggaaaaatatgagggagaggcgacactgttgattgcttcagttaccaaccctaactaacagcatctgtagtctgtaatcactgctgtactgtacatactgtactctctgctgtatcggtatgatgcactttgcttttttactgtttgaatttttaggacatgcttctgaaaggcatgggttgtgccctgccaaccggttttactccttgcacgtgggttgcacctccaacccacaaacaggtcggaacatgtctgctttccgagatcaattcaacgacagaggcgatcggaaaccaagctaacagatggtaatcatactgcgccgtgccatgcttacaaatcacaatgcacctactgtacatactgtacgattgtactagcagataccccatctcaacagccctgtacacagccccgctaaacctactgtcaccatcgctactgtactgcagagaagagggctaacgcgagtttgtttgtgtgggggagggtgtcagatcagctccgacggagaaatctgagtaattcgtcgacaattggagcagttgtgaccaagacaaatggtcacgcccggcgttgtgtccttctttgctcattgatatggtgtaacaatgataaaccaaggcccattgattgagacggagatattttcggcgtgtctagggtgtctacttgtgcaccggaacatggaagatcgtgcgctgttcacttgcaacagaaggctaacgagagaaactgggccaacccgtctatgctcttcatgctactcaatctattcaaaatacgccagtgctccccttgccttatacacaggctcttcactcacatcttgaccatcttggatgtgggtactgtagctcctgggaaccagtcgtgcgggagcatgagaaccacgtcgaagaagatggtgacccaggaaagcaaaaacttgggcacattcttgtagataccctgacctgtcgtggtcgaagataccgtcgaaaaccagctgtcccattgacagaaaccctcctcctgtatctagcagaacgctggcaatagaaaagccattagtggactttcgcgtgtagttcgacgcagcagaggatagtgcttgtgtccagaggtgtccgagcgtcgacaagcatacagccctcgggtggttgtgtcgaaatacaacagccagtcctccacgatccagctcagatagccctgggtgttgagatagagacaagtcgagcgagatgttctcagtggacttgagtttgatgttgtgaaagatggttggattgagagcacaactccatagaacatagtagtctcagtccatgagctaggagagaatctccagtgctgatgtcatttgaagaagaagaggaagaagaagacagatagatcaactcagccccttccagttgccgtacaatgactcaaccaaatacgttcaagcctgctttcaagcctgcgtgctctttctgtctcattagttgaacgtagatcatctgagagaacttggcagaccgtgcaaacacaagggcgagactgataggacacttgatctgatccaaaatttgacagaggaaaactagttttgaagttactgaacgtttcttctccaattgcttctaacccccccccacataggtttcggggtctgccagagttccgacacagagacttcaaacaagtaagtgacgacaaaatatgatctctgatgagaacttgacttggccatatcgctaaaatacccaccctgaactttttgcgttcccttgcattgtaaagaccaccttgtagatgaccaaaggatgaaaccgccatttataggctgcaaacaaacaaaaaagcgacacgaagcgattggcaagaaatatagtagattgatacaattgattcatctgttatttcagtatgttctgaaattcaacttcaagatcagtgcctaaagacttcatcgctctccaatcatgatctgataatagtgttgagaacgagactcacgaattgaagctagaaatgatcttctcgagaaagggagcagttctccacattgttcaggttgagtttcatatcatatatcttttcatgtgtctccaaaagccctctgaacgcttttaagagtccttcgaggaaatccatcacgtgacataaatctatggatgtctagtttcaagagatgtaaatcttatgtaatgattcggagacactcataagatgtcagtgggaggcacgtgacatagagactagggttacgtggaaggcacgtgcctgtgtgactgcgagtgcccaaataggacatgcggggtactcgcctttggaggtataagaaggattattgtatatgattaattgattagcttattattgaagttcgacgagaccagtagatccaggagcgcagtattgagactagcagccttggatagagtattacgacaagagatagtacgcccgatctgttacacgtggtagcgatgcatcctcaacaaactagaacacttcgaagttcccgaacagtttcgagtcggtgtggccgtcgtggccatgaccggccttgcagaggaatggtggttcgacagtggtagggccgctctgggcgcagacgccagagattggaagaaattcacccaggccctcgagagccgattcactccctcgacttacgccatgaacatggaggaggactggagcaatctgcaatgtgggcccaacgagtcatcctattcctatgagacacgcttccgagcggcacgacaccacctgtccagagaggccgccccagaggaggcctggttacggctgaccagtggtatgaaggacatgtggcgacgtgagatcatgaagcagggccccatactgcagaacaacgtcgaggagaccctgcgtcatatgcacattgtggcaggcgcagaatacttcccaggagctcacgcccagacacccgcggccgcacctgtggccacacctacatccaccagccagtacggtcctggaccgatggaggtggacaacgcggtgctgctcaaggctatgatggaatcgcaggaggccagccagaagcgaatgatggaacagcagacccatatggttgaactgatggcaaacgccattggacgagctaacaacaacggctcccaaaacggccgcaacaaccgtggtggccgtggtaactactacaaccagcgaacctctcgtgagtgctacacctgcggcaagattggccacctggctcgtgactgccgacatcgtgaacgtgttcaggaactgattcaacaggaccagggaaatgtgcgacagcagtaatgaccgagaccattactgctgagccactcgaagatctcgaatcggtgagtgtgccacctgcggagtatgatataatcaataaatccaactttgtagaggacactaccggagaaccggaggatgcaggggtagaggtgcatctggaggaagagcaaacggaggaaccaatgcagctggaggaagaacaagtgggggaacaagtggaggaaccactgattgctgcacgagttgaggtggtagatggtaagcggcgacgagccttgatcaagggcgaccgaccaccgatctcgatcccgtactgctacaacggtaccacagtgcaggcgttgttggactgtggcgcgagctcgtgcttcattagcaggaacctggctgagaaattaggcctgaaaatgacgccctgcaaaccacgacaagtccagtccgtgcatagcatggagacaaccaactatactgtggaagtaccggttgagctgggtaagtggggttgcgacgtgtttgcgtacgtcttaccccagatggtcggacaagagctactattaggcatgcccttcttcgaagagtatcatgaagccgtggatttcaaagctcgaacgttcacacccgacgggtacgaggtaccggcatggccagctaacgagtcaactacgtgggacaaacacggccacatcaagtcgtgctcactagagaaagctacgcagctggccgaacaccacggtgcgcagctgttcctctacatggtacgggagaagccagagggggaggagcatgagccggatgtcgatacccgagaggtgctggaggagtatgcagatgtgattgttgacaaaatgccaatggagctacctccgaaacggagcgtagaacataccatcgactccgatgagacggcacgacctccagccagggcatcgtatcgacttacccgattcgaatgggctgaggtcgacaagcaggtaaacgacttgttggagcgaggaatcatccgaccatcgaagtcaccttacagcgcaccgttagtgattgtaaaaaagaaaggaggtgaacttcgtatctgcacagactatcgcgccctcaacgagcttaccaccaaggatcgatttccgctgccccgtatcgatgacattctggattgccttgacggcgccgacaccttctccaagttcgatcttttgtcgggctactggcaggtgttggtaaaagagtctgatgtacacaagacggccttctcgactcgatcgggacattatgagtacctggtaatgccgttcggtctatgcaacgctcccgccaccttccagagattgatgaatgacgccctacgaccattccttaacaagacagtctgtgtgtatcttgacgacatcatcgtgttcagccgaaaccgagaggaccacaaacgacacgtgagggaagtcttggacgccctgagagcacagaagttctatgccaagaagtcgaaatgtgagttattcaggaagaagatgggattcctgggccacgtggtgtctgcggcaggagtggagccagaccctgagaaagtgaaggttgtggaagagtgggtacctcccaacacgccgaaaggcctcttgagctttctaggactgactgggtattatcgacggttcatcgaagactacgctaaaatcgccgccccactcacagacgctgccacattgtcgccaactgactttaaatggactgaggcatgccaggtggcgtttgaacagatgaaggcgaagctagtatcgaacgaggtcatgatcatacctacaatggaggacacgttcaaggtgagtacggacgcgtgcgatattgcgatgggcggagtactacagcagtggagtcccaaggaccaagagttccgacctgtggcatatgagtccacgaagttcaagaaacacgagatgaactacccgacgcgtgagaaggaattctatgctatcatccatgccctacggaagtggcgacactacctacttggccgaccgttcttgattgagacagatcatcagtctctgagttactttacgtcccagacacaccctcccagtggacgactgagtcgatggctcgacttcctagcggaatacgactttgagatcaagtacgtgccgggcaaagacaacgacgcagccgacgggttgtctcgtatgttggcacagacagcgatggtgttcgagccggacgactcgttgctagacatcatcaagcagggctatgagtcggacgagtactttaaggacgtcttcaaggtactggccacggaaccggtggtcatccccaaagagatgcacaaccacgcccgccatttccgatacgacaagaacacaggactgctgtatttcgcctccgtttacaagggggagggagagcgactctgcgtgccaagaggtaaggccagaaaaatgctgatgaaggaggctcatgacgcaccccttgctggtcactacggatacttcaaaagctatgaaaggctggcgagggcttactactggccacgaatgatagaccacatgcgcaaccacaccagatcctgtctgatctgccagaccacgaaggccagacgagcaccaccccagggcttgctgaagcagctgccggtaccgacgggaaattggcaggagatcacaatggacttcattggaggcatcccaacgacccatcgaggccacaacaatatctgggtcacggttgataggatgtcaaagatggtacatctgattccttgcaagacgagcacggatggagaagagttggcggacatgtacattgaccgcattgttcgatatcacggagtacctcgttcgatcgtgtcggacagggacaagctattcacagcaaagctatggcagacgttacagacacgtctaggcacagagttgaagttttccacagtcaatcacccccagactgatggacagtcagaacgagtgaacaccgagctgattcgacagatgaagcaacacttcgtcacggacaaaaactgggacctctggttacctgtcatcgagtttgcgatgaattctgcaaagcattcgtccaccggatacgcacccttcgaggcggtgtatggatacatcccagacggaccaacgtatgcctcgactcgagagctcaccaaggtacaccatcaaatggacgcttggatggacaaactacgggctatttccaattcgatgcacgaccgattaatcgagcaccaacgggtccaggagaacagggtgaatcagcatcgagtgccagtcgcgtttcagattaacgaccaagtcttggtacatcggaaggcgttctttgacaaggccaagtacgcaaagatgtatgacgtctactttggaccatttcccatcgagaagaagattgacaccaatgtctacaaggtgcagctaccatacgactcgactcgacacaagaatatcaatgtacaacacttgaagaagttcatacctcgacctgagtatgacatcaacccacccagtacggagtactctcaagaatgcagcctgcatcagatcaccagcctggtgggtattgatgacgaccgttacttcgtaacttgggaagattgtgacccctctattgcctcttcaatttcgaaagagatgttccaccgcatccctaaagacaaacgggattcactattggatcaatggaaccagttcattaagacccctgcggaaagcgaggactatgtggacatctcctagggggggagagtgtaatgattcggagacactcataagatgtcagtgggaggcacgtgacatagagactagggttacgtggaaggcacgtgcctgtgtgactgcgagtgcccaaataggacatgcggggtactcgcctttggaggtataagaaggattattgtatatgattaattgattagcttattattgaagttcgacgagaccagtagatccaggagcgcagtattgagactagcagccttggatagagtattacgacaagagatagtacgcccgatctgttacatcttacaaccttaaagcgatgtggcgcagcggaagcgcgcagggctcataaccctgatgtccccggatcgaaaccgggcatcgctattttttgtctcaattttttcaagaagcgaatatatatatgtttcatcatatcctcttaccacagttagcacctactagtaaccattcaattaattggaatcattttattatgtaccacttgcgttaaccagtcttaatgagacaaggcatgctggaaaagttgaatctatcctataaatacgatgttgaatcatactgtgtattgtatgagtgccttcttattcaagaacggcgcagaagccagtaaggagaccctcgttcttggcccactcgaaaaactgccgcacaaactcctcctgttgttgtcgggtgaaggtgaacatgagagtgttgagcagcgtctcaaccttagacacatggttggacacaaaggtctcgtagtacaggtacgagaagaagcccatgaggaactggcagtccattcggtctgtgattcctccgtggccgggaatggtgtctccaaagtccttgacctggaaggctcgcttgagaccggaggcgaagaagcctccaaagggggccacaagggaggcaaaagaggccagaatgccaacatggaagtggatgggcgcggccgagaaggtggttttgtgggtgagctgtcgcaggaactcggtggggatggggtactccttaggcatgaagacggggttaggaacacacgtcaggttggagaagaggttggttcccatgtcctcaacggggcagatgaagtagtcgaatctgtagaggaagacggagaaaatgactccccagatgatggtgcagatccaggctccgaggaagccctcgactgtcttcttgggcgagatggcaatgagctggtgcttgccgaaagtgatgccacaaaggtaggcaaaaatgtcattagaaatgacaaggccggcggggacaaagaaccagaagagaccctggaagatgttgttgacgatgaagtgagcctggacgacaccaaacagcagggtcatgtgggtgaggcagaactgggtgaactggaaccgatagtggttcttctccagggaggcgacaaagaagacaaagccgagaatgtacaggcagtaggagaggaaccggtggtgtaggaagagggtgttgagggtgttttccaggtccgagttgttctgcttgatgaatcggatgatattctcgccctccagaaagtagattgtggtggcgaggaagtaccagttaagggatcgaacccagggcagctttttctcgctggcgggctctgaagccagatttatcacctccttgaaggtcaggatctggacgaggccgaccagggcaatgacccagatgtggcctgccgccagcaccgcgaagaagaagacaatcatgacgagcgaccagatggttcgcacaatgaatgcctgcttcttggactcgggcgacgagtccttggcagcctttttcagatactcggcctctcgtgacgagtctctggacgtgttgagcgacgacactttggagtttgctcgcgaggtgactctggagacagaggccgagtctgctccggacgtgtgggcgtcaattttttcagacatggctcatcaagtcgtgtcggggatccacggggtatgcagtttggggctgcggcgaaggggagtgttttttgtggggtggtggggggaggaacctgaagagtggttgttggagaaacgtggttggaaaatgatgtccactgtgtttttacactttttgcttgacctgaaacttttgtcttttttttttaatttttttttttacctcccaatactcccaagaagccttgaccagccagtgtggggtctctacgagttactacagcagctgtcaaggttcttgttgagctggagaatgcaaggcaccgagaggtgaggcgtcggccattgagcccaagcgacggcgggatctctgccacgtgatcaagaaccctccatccacggccacagcactcaccgtctttcgccaccaggctcactcacatccagcctgccgctctattaactcgtgtctgtcgcgcggagctgcatccaccaacacacccaacgtcatgctcggagatgcagtctgcaacgtgaaaaaaacgattggttggcatgtttgggggcacgacaataacggcctctagaatagcgacaagaaccgagaaaatcgacttgggaaagccccgcccccgtgcccgcccgttgttgctgcaacgtcacccttttttttctcgcaagcacgtggccctcattgcttctgtgtgatgttacctttgggtgtcagacgtcccacatccaagtagtgagttgcgtcaacagtgttgaagaagctaattgggagctctgtgtatggtggtgagtttaaatataataagggagaaaatcggccgtgaacacaatccgattggacacaaaaacagcacaagtgggcatttaaaggcctgacgagcccacttccagctcttcacgcactccgacgtctaccaccaacactaaccccccccacatgacgtcacctacacgtcagatccgaaatcacaggccgaaataaaaataagggccctcacagctccactgcatccaaccgggctcaccaaactctaagagtaccagctcggggggaaccaacagggggggtctctggagcggggtatcgcgcagttggaagacatggcaccagataccatgaacagccatttcagggtcatgttcatgtgacccaatggcacgtgtcggccattccagtcggccaaactcacacccagattaacacgcagcttatgtttaggttagtgcacgggacatccgatgcagagatccgaggttggtcagctccaacctgttgagccgttgatattatggtgtcactgacaagggaccaggggtaccgtatccgtatcgtacatctcttggtgcggtacctgtactggcagtctaagcatgttcagtcctgtgagtgatggactagcgcacatcagtatgatacgaagtgcgctgcacaagaaggaagaccgacaccggagcttgaaaagtactgtgcctcggtgaggtatttcccccgaattattgtacgagtacgagtactggtacatgcgatgctggccagagagctgcctggcaagatcgatccttgtggtcaaggaagtacaacgtgcgacagtcggacaggtcttgttgactcttgtggatgacagggaagtgaagcaactaccaggggtattgggcgaacgttttggatgagacaagttctcagtctgttcagaccagatgctgatacctcagacatggatggtggagtgacgcagtttgaggtgaagaatcgatagacccaagtacttgtactacaccagtagtcatattggagctcttggtgaagagttgtacaacgctctcagatagtgtcggcaaaatatgggtctacggctactgagatccatctgtacttcatttcagggctaccagacgtatctcacccgtagggggtacaactgtcaccagtatggtagatacaaggtctcccgcagcgacacagggcttggacggactcccaatgttactatccacttatagtaaagggaccggcacttccgctctctctattgtctcaagcttaactacagtcccacagtacatactatactaggaactggcaaagctatacgctcattctgctgggacttttgtgagcagaacagacgggaagattccgtggagttctaggagttcggcgattgaagtctccacatttcaagttatcaagtcatcatcaagtcctatcaagagtccctttgacctagtagtgaccactcactcactcggggaaatcaaggtctctcatatgactctctgcacgaggttcgcgaatgagcttcttctccgagccgaatctcaatgtcaccaatagcagctctttaggactctcacacaagagcaccttcgagtcccgacttccagcccaattgcgtcagattcaccaccacaggaggctggtcgaactatgacaacatccttatctgtgctcgtctctttcaaaccaatcacggcttcacagttacgaaccacagcctgtgctagagtatgtaccttgtacaatgcactcggtaagacatatgaatggcttctcgcttatgaatcagaatccaacactcaccatggtgaatctcagtctacaatacaatatcacccgtggttctacagttcagatacacgctcgcttcggtctacaggtccgttcactttactatgcaaagttcactcgataggatacgcaatttttactctaaactacacttagaatcgtcgcttctgggaagagaggaaagaagagtgggtctcgaggggagagggggtgagggcagtctcggtccacaggttgggggtcaggaagccgtaggtgttggcaatagcaatgaaggtagccttgagggtgttctccagggttcgggtggaaccggcagaagaggtgtagacatccttgataccaccgagctgcagaagcttcttgacagcaggggaggcaacaatggaagaacctcggggggcggggatgagtcgaacgttgacggatccacactttccggaggtcttggtggggacggtgtgaggctcaccaagagaagaaccccagtatcctcgtcggacggggatgatggcgagcttggcaatgatgatggcggctcggatggcggtggcaacctccttggcggtcttgataccgagaccgacgtgaccgttggagtcaccaatgacaacgacagccttgaatcgggttcgctgaccggctcgggtctgcttctggacgggcttgatcttcatgacctcatcctcgagaacgggcaggagctggtcaacaatctggtactccttgatggggagagcgtgcaggtagatctcctccatggacttgatgtgaccggccttgacaagtcgaccaagcttggtgacgggaacccatcccttctcctcgtcctttcggcctcggcctcggccacctcggccacggcctcgtccgccacggtcacctcgaccacggccaaatccacctcggggagcagctgcttcagtagacatttttgatatatttgtcggttgtgaagatgaaattcgtggctcgcttttttcactacctgcagttgggaggaaagagtctgtgactgttttcccaaacgggaaaaatcatgtgacagagaagaaggctaaacaatggaagcttatttggggtgatgagatggatggggaacgggataattggggaaattcagattaatgcactcaccgatctatttagaaatcgttttcgcccgattcaaggaataaattcccggtaccgttagtaacgacgattcattaataccaataaaatcaaattaaacaaaaattaagaccgaaaaggtgttggaaagggtttacacttgagattctgacacttgtatggctttttattatttgttcagccttttcacgtctgtggtaagcggtgggaagtggtgattaatctgattcaaaacggaaaaaagtcgatcaaaagactgtcatagctgaacatacagagcagtccgattgcttcctgtttgaaacgtttatgcgcagccacttgcagatactgttggctgattctactgagctgttggagctggtcccgcctctccagatcgtataacgtttttagccagtcccattgtaaagacggcacaggcggtgcgtgtagtaccactaacggtctacaatccagctacagtttcaccgctgtttggtagttccaggattctcgtctaaactgctttgcgcgccagctttagtggttggtttccgttggaatcttgaatacgagagctcggaactgaccatagtacgtatttacatacttgtaaaaaggaacattcatcaccggcctccaattccaaccacattaaaagtagatcatcacttgacacaagtgcgattattcattttcatgtttctcaggaatcgacaacgactgtgaaccgaactacaagtagccgacaagtgttcaccaagcccagattacgagtgatgctgtgatatcacatgtccgcgacaccagtttatgtctgaaagggttatattgacgcaagccctcagtaaaagtacattgtatcgtctcaaaaactgttcggttctcctctcccctttttcgcactgattcctatcaagattcctcttgtcggagccacttgtgcttgactctcgtatattgcggacctcatcgcctgtttcattaatacaatgcagcatgtatcgtaattacagtacctgtaaaaattaaatttatgttttttttttttttttttttttttttttttgcacatgagaagaaaaataaaacaatggagcaggctttgcggtggtactggccaagttacagtacccattaacagtagcaatccatgaactcgtactccgtcgaatgatacagcatcgcacatgttcaactagtgccacctccactcagcaaagacaatagatgatcaggatcatcgcaggtgtttttcttgtgcatctcagccagccgccgcaacagcaaacacagactacagccccgttttgttccgtcctgggccgggtgcatgagacctgtgtgtttcgacacgccactgcagcagcaaacatatcacatgttttagcgaggagggcagttggtggcggggttgggagaagaagagtgctctggaggaccacacacggtatatataagacattcgaaaggacacaaaacacaagggctccttcccacatagttccacatgtctctaatactgcacacaccctccaatagttcctgccgaccttctgcttaaggttcgcttgatcggcaagtggttagtctaggtttggagtcaggcgtcgtcaagttgctaccagttatattatcacctcacacttccttccaaccacacaaaaaaccatcatgtcgtgagtaacaacccggagctattggacgcccaatagtaaggaccacacggatactgtgacgagcagtaccatgccacatgacctcaatggttcatcatacaagaccgcaatggcagtcaccggctacaagtacccagacggcgagttgtacgagacgactcagagactgtccatcgcacagtggccgaggcaatcaagacatgttgaccaggcaatttgcacacgacgcctcccgccacacaccgttactaacccagccacactaacaagaacgagagctacgccgacgccgcccacaaggccccccctcagaccaaggaggagaagcagtgccccgttctgacccctggccagcaggaggagatcgagaagaaggccgagaaggtcgagaaggagttccgaaaggtcgagaaggatgttattgctaagaaggaggagcttgccgaggagctcaagaaggacggcaaggctctgtccgagaagtcttccgagctctacgccaagatctccaacgagctccagaaccccgtcgttgctgccaacgttgttgtcggcatcgtcgctgccattggtgtcggttactccgcttaccagaagcacacccgaggtgagcttgacggtaagctggccggcatctacgtcggaggccttgctgccttcggtgctttccagtacctcatttctgctcgatcttacaagaagtttgagtaagccaataattaattgattagaatgtgtatttgcccaccctaccgcgaccaactactcgcagcttttgagtgccggcttgtgcttgtagttattctgactagtgtcgccaccgttggttatttagaccagctccggatggtcacctggcgttttaggttcacatgcgttatcggggttggggttctactgagttgggtggtaggatatatatatatatatatatatatactatgtctatatccacgagctcaagtagttatgttgtcgtaagcggacgacctgaggaaagtcttttctacatttgcatattaacagaaacacaagtacctccaacatgagtctctctctctccaactagtccacccacaccccgtcgatatcaactttacattagcgtgcagtagccattatagattagacaccctgcagttttagaccatccctttattggacggcgctcttgagcgctacgagacgctgcgagactatgtcctttctgtgtctgaataaggccacactcttcttagtggaagaagaggacggtggcatcccttggtgtgcaatacgtgaatgtacgctgctttttgctagatgcaggtagctcgcatagccgggtctaggttactgagttataatgcgatggttgagggactgggatagagagttacgtaatgtacaagtacgctataccagtaccagtagccagaattaactacaagtagttaccaccgtacaatatcttgacgaaggtgcccccgttaagacctttgctgatcgtccaaaggtttaccaccgcaatggcccatatgaaccagcacagtggtgccagtggtgccatagtcatatggtatgatactgtgtatgtactgatgctcgagtactgtacttcaactgtacatacgtaccaatagtcatgttcctgggtacacgaccttagttgaaatctccccgccagacacgcttttggctaatatctaatatctaatagtgcagactttggattctttgcatggaagccggaccggaacaccaacgagtctgacacttggcttcaacaaatggtatcgttcccgtgttatatctccacggatcgtcatggttggtgtttcacttctccacggagtttattgtagccaatgagagatatgctgatagacacactcaatcgggtatttttggccgacagatgtaacagatggaggtgggatataaaccaacacaaacggttgctacaattcattggtaattcttgttccccccccccccacaactgcctctcagggtgtctataacccccaccttctcttgttcttacccaccgagtgcagcaacaatacgagcatctcctctatccaatcaaaaatgcggaaagaggtgaaaaaaatcacatttgactgttaatgaagcaacagagatctcaaataggacgaacaaaaccgaacaaaaccccaacttcatgtgtaaacggcccactactctcattttcaatcgtcttgacacacaccttatcgttccacaaatgactcaattgagtcaccgcactctccacccccgcatgataagcaccatctttatcttgtcaccaaacctgtcattggcaataaactccgccttatccactaaccatgacactgaccgatctcgtgagagcagagccgtcgggggcgcttctggtctccctggcaactgcttacctcgtttatctcgttgtggtggcccaactcaacccgctgaaaaaatgccctggaccctggtacactctttacagtaagatgccgattctcgtcattttctggagagacagccgaaacagatacgtgcaggccttgcacgagaaatacggacccattgtgcgtctgggtcccgacgaagtatccatttgcgaccccaaggatgtctcaaaggtctatctcggcaattttgataagtctcgattctacgcgcagtttggaaactatggagcccctaatctcttttgtattcttacaaaggagccccacatcaagctgcgaaaactcatgacaggcttctatagaaaagagactatcaacggcaccggaatcattcaggagaaggtggacgaaatggagaccgttgtggcggccaacaacaagcaggacgttcacactctcttcagataccttgccttcgatgtagttacccgtctgacaatctctgattcggaaatgctggctggtaggaaccagaaactcgtcttctaccatgaaatgcaaacctccatgaccttctggaccactctgcagcccaaatggtgggatcttgctgctgccctgagcgagagacagactgtgttgggcgaaaagacctctatttccgaagctagccagagatgcaacgactggacctttcaacagactggagatcctgacacgcttctagacatgctcaagtcaaagggcgtgtcccacaagattgccatgagcgaagttcaggaccatatcgctgctggacacgagactaccgctgtaactctggccttcctcttccacagactggctcatgataaatccattcaggataagctgtacgctgaacttgaacccatcaatgtaactcttgagtcagtcgactcacttccttatctcaacggtcttatcaacgaaaccctcagactccacgctgctattccaggggccgagccacgagtgtgccctgctggagtcattttccagaacgtggctcttcccaagggaactatcatttcagcccagccatacactcttcatcgagacaaggcctggggagacccagaggaattccgaattgaacggtggtccgaggatcctcctctcgcctacttcatgccttttggagctggtatccggatgtgcattggaatgaatgtggccatgggcgagttgaagttagctactgcccagctcgtcaaaaagtacgagatcaagaagtccagtcctcaacaacagttccccaccatgaaggactcttacacgactttgcccgagggagacaatactctgctgtttgaacagagagctacataaataatatgactgagattgaggctgaagtacaagcattgtagtaatcgaacattgttaggaaaatctccaaaaaaaagtgttgactagcttcagaagctaggggagtcaaaccccttatttgttccagtttaagccattgtcaatcccataggaatttgacatggacaggaattgaacctgcaacccttcgattacaacaagaattgctggagtcgaaagctctaccattgagccaccacatcaacactgcgtttttaatccataaatacagttaacatcacacatgatggattaggttattccgctttgggaaatatgaatagtcgacttttccaggagattgaaaatctatatcaaagtattgtacttttagatgatatttccgtgtctttaaacctcattgttctctggaaaatcctgtaataacggtgtgttggcccgggcatcaaaataagtttggatttagcgaacatgcacgttgaaggtgacgacactcagaaccatcactaccatgaagttgcaactgagtgtactggcctgtgtggcatcgacggttgtcgccgtttttatcgacgaggttggtgtcaacgactgggtacgattaagcgcccccgaaagcatcaaagtgctcgacaatgttgcatatttggcatcggcagacgctctctctgccctcgacctttcttcagacgcccccaaggggatcaaatggagccggcgattttccgacaatagctcaatcacactcaagaatgaccacgcgattgtgcaggaacaaagtgtgtcgtacgggttcaatttgaaagacggaggtctgtcatgggagagccatgagaaggacgtgctcaaggagggtgttattgtgaccacagaggacgacacctatgtggcacaagctgacaacgctctgggatcaattaggctgttcaagctcaaccgaggagtgcccgaggaacaatggtccgctactgctgatcccatcagagacctggcggtggtcgatatcagcaccggggagggagagcaacaggagatcaacacttcggttgttgctcttgaggacggacggtccagcaccaaggtccggatcatttctaaggactccgacaagtccatcaccatgggtctgtgccagcgactgatcaagttccagcccttcgcctccaagtttttggtttcgtgtatcatcagcgaaaaggtgcacctgaccctgatcgatctggagtcgaagaagactgttaccaccagcgttatcggccaggagggccaggttcatgtctctggtgctgatatctttgtgctaggagatgacaagctgtataagattgatctttccgagtttgcgcctgttctcatcggtgacattccccatggaaaagacgctgtcatttcactccaggaacagcttgtggttcaggactctgctgcaattgagacgttcgactactctctcaacaagaaggcttctgtggcccagattcccttttctctgacatacactgggtctgacaacttccttgttgcctctcctacgtctctcaacgtcctcactcccgagggtaagtctctgtggtcttctcctgtcctctcgtctatcatcactgctgctttcattgacaaggatgaggtcaaggccgatgacgcttttaacatcaacaccgaccccgtgaccgcctttatcaaccgaatccagtcccacgttgcccagctgcctcatcttatcaagtggttctcttctctaacccttgacgttctggaggtgtctactgacaacgaccacttcttcgagaagctgctgattgtggctactccctctggtctcactgccattgataccaccaccaacaccaacgcctgggaggtggatattccaggtgtcaccaaactcacctctgtcgctaacggagttgttgctaccacacccaatggagacattgcttacgatgctcacggagtggagttcagtgctcccgagtctgactcggagtacaccgtcaagaccaccggaaacattattcagggatacaggagcggccagcccacctggacctggagtcctgcagctggttccatcgccaagaccgtgtccaagaatctggacgacgagtctgtgtctattggcactatcctcggagaccgaaccgtgctatacaagtacctgtaccccaacgtaattgctgctgcttccgttgatgaaactgccggaactctgcttatcactgtgctcgactctgttacaggtaacaccctgtaccagtctattcacaacgacgtcaagtccttcagcgacattgttttcggcgagtactggatcacctactcttatgtttctggtggtgcccttcccggtgccaagctcgtcacctgcgacttctacgagtccactacccccaatgagcgaaagtccactgacgagatgtctgcctttgacatgtttgttcccgagaccatctgccaggcctttggcatcgagtctgaagttactgctctatctgtctccaagaccacctttggtatcacatcccgagatgtcattgtcgctcttgctgacggacgagttgcctcaatccctcgacaggccatcaaccctagacgacccgttggacgagctgctactgctgctgagatggaggaaggtctgggaacttacgatcccttccttgccatcttcccccagatgctcatttcacactcctattctctaaagggcgacatcattgtcaccagcggagctactttggagtcgacttctctggtggctgttctatccaccaacggagacattttcttcacccgaatcttcccttccaccgccttcgatctcatgaagcccaatttcagcaagaagaacctcgtgtacactgtgctggccctgggtattgccgtgcgatacatgggccccgtggtcgccaaaagactcaacaaccaaaagtggggtgttggtctcattgagaaataagaaataacgataatacatgtttgactagatgcccttactacaaagtagaacgtgccttacttcagtatatgtaaaccggctgtccatagagaaaccgccacagatccaaagtgtgacatgttctgatttggctgccttggtctattctctcacccatacatctcacctcaagtggtctgagggtgactacttggtgctgtttaattccaatattgaactcattattctgtacatatttttattgaacgtttactggatttactccttgtcggtggaatcgaaaggagtgaggtccttggtggcctcctcccaggcaacatcgtcggcggtcatgacgttgatggcagcaatgacggcgtcgatggagcctcgaacctgtcgagtggagtctcgctctcggagggtgacagagttgtccttgacagtgtcgaagtcgacggtaataccgaagggagttcccatttcgtcgtttcgggcgtatcgcttaccgatagaggcagaagagtcgtcgaccttggcggagattcgggcctgtcgcagcttcttggagacctcctgagtgaagggggccagctccttctgggaagagagaggaacaacaagaaccttggtgggggcaattcgaggagggaaagaaagcacacccttggctccggaggcgtcctcgggtcgagtccagaagcagtgctcgatcagagagtaaaggattcgtccgataccgaaagaaggctcgatgacgttgggagtgtagtctcgaacgtgggtggtgatggtctttttctcaatcttgatgtgagacttgtcaagctcggtgccggcaacctcgacaccctcaatctcgggcaggacaatcttgccggcctcaagagccttggcaagatcctcaagctcgcactgggttcgggactcgaaccactcctcgacgggcttggcggccttcttgagcagaggaccaaacttcttcttgtcgtattcgcagacaaacttgtcctcgacgagaggagcgtcgagcttctgctgaacctgcagcttgaccttggttcgggcctcgtgcacagacagatcgtaggcagatcggtcagcacagccaacacactcgatccagccgtaggaggtgtgcagctcggcatcccagcagtcggtggcgtagtgggccatctcgttggacatgtgctgtcggaatcggagtcggtcggggttgacaccaatcttgatcaggaacaggtagattcgagcaaggaagtatccgagggtcttgttgtcaacgagaccggtctcaacggcctggccgatggtcatctcctggatgtcggtcttaccagcggactggacatccttggcgaggaatcgcagcttgacgtccttgacctcgtcgaatcggtggtggtccttgtccagagggtcgacaaagtgctcaatctcggccatggtgaactctcggactcgcagcagaccggatcggggggaaatctcgtttcggaaagacttaccaatggaggcagaggcgaagggcatcttggtgttgttgcagtccagcagcttgttgaagttgaggaactggccctgggcggtctcgggtcgcaggaagcccttgagcttaccggaggggccgatggcagtctcgaacatgaggttgaactccatgggcttctcaaggggaccgccggtgacagggttgacgatcttatacttgtccatgatctcaccaagctcggggccggagaaaccgtcaatcttggcaagaatggtctcgtactcctccttaacattgtcatcgagcttgatggccacaatctccttgaccttcttctttcgcttcttggcggactcgtcctcaacaacgtcctccttgatgcctcgggcctccttgtctcccttgagtcgggcctcgagcacctcctcgaccagatggtcggctcggaaaatctcgccggaggccagatctcggcacatccagtcggcaaacttgtccacgtggccagaggtcttcagaacctcgtggggagtcagcatggtggtgtcgacctcgagcatgtcgtcctcgagcacaaagtgatctcgccacgtgtcgatgattcgggtctggagagcacatccaggcgggccgtagtcgtaaagaccggaaacaccgtcgtagatctcaaaggctggggcgtagaagaaccgtcgcttgaggacggcatcaagagtctctcggttgagctcctggtcggcgggtcgggtggacattctagcggaaaaattcgaactgactgagaattgacgtataaaatggggggtaggaatcagcttcctacgtagcagatttagtgaagtcacaatggcagtagtcgtaagagtggactggagttaaattttccaaactttgcactcttgtaaaaaaaaacaacggggtttgggagtaacaagaaaagggtgcgtgaaagtgaccccagcgcagtatgcatttgctgtcaatgagagatagatgataacgagtccctcgtacaagtcgtagagcaggcgtgactacaccggaattgtgtttcccgagagcttgaatcccatcacacatctataacaaagaaaagacgtcactctttgtgactcaccatgtctcatccatcacccgtactcgtacttacatgaccccctccgacaggcccttcctagagccagaattagttcctgcctcagatcattgaaggttctagtgtgtcaataaacaccaaaagggaccgactggacgcagacatagacagactttgaactacttgttggacaatgccattccacagggctcgttttttctcgcccggtatcccctatgggttcatattcggcgatattccgggcctgtccaattgagttagtcagggttccagagcatttgaacaatgcaatgtagagtttgaggtttgtacccatatacgaaaatgtactggaaaatcaaataacttggatatatggtgggtagagtgccagatatatagctattgggggaatttaccacatttatgttttcccgcgtctgatcaagttatattgtaaatcgagttgatgcacttttacttgtattctattctattctattctattttattatattatattatattatattatattatattttattttatttttgtattttcccacaaacctcccactcacgtgacctaaatatatccctacctctgcaccaactcagcacattacacacacatcatgggatctatcttgctgcctcacctgaacacgggctggcacgtggaccaggccatcttatcggaggaggatcgactcgttgtcattcgattcggccgagaccacgacctcgaatgcatgaaaatggacgaccatctgtactcggtggcggaaaagatcagaaacttcgcggccgtctacgtgtgcgacattgaccaggtgcccgagttcaaccagatgtacgagctgtatgacccagtatcggtcatgtttttctaccgaaacaaacacatcatgtgcgactttggcaccggagataacaacaagttgaactgggtattggaggacaagcaggagctcattgacatcatcgaaacagtctatcgtggagcaagtaaaggtaagggtctggtggtcagtcccaaggactatagtaccaaacacaagttttagagaaaggtctacttgtccacgacgggataactctgcatcatagaaagattagtaatttatatgtaatatagccataactacgacgtgaacgggagttcatagcgtgcaccatgtgtttgaggaatgtatgccatgtctttacaatcccctacgtgctcagatcatccaataatatgctggttactatgtactgtttttgcgctaccaacgccttctccgtgtctccttctacgtcgcctatttcttcttcttcaggtcggacttcttcttctggacctgaactccagacttggtctcgacgaagtcctgacccagcaaatcggcaaagtcgtcgtcgacctcgccgaaaccaaacttctcgttgaacttggacatctgcttgccctcctctccagagtcggtcttgagctcgggcttgttggggttccagagatgcacgtttcgctgatcattaatgggcttcagctgctccacgggggccacggttcgtcgcttgtaggtggagccgtcggacagctggacggtgcactcaaactcgtggaaaacgggagcgatggtctgtccgaaagcgagtcgcttttgtcgcttgggcgctcgcagaatcgaggcgtttctggcgttcttgattgtcgtcagggggacggtagctcgcttgaacatgtttgtgactgtgaagtgatgtaccgtgatccgaaaattcactaacacagtttggatgttgcagggttaggtttttttcagacgaggtaaaaatcagctatacagggggtcgtgagttcgagtctttggtatgagcataacaagagtgcttcttaaaaatacattaaataccgtaaaatacatacaagttgtacaaatagtactaccattccttgtcctcgtccttgccctcgcccttgccctcgcccttgccctcgcccttgccctcgtccttgccctcgtccttgcccgtatccttatctttatccttatcgtcaattcgctgctgagaaatacccgacaggtctcgcaggctcttgacgttgttaagatgaagactgaacatgttgagatcagggtcctccacagggggctccgaagaggattcggtaataacagccgcctctgtagtctcaggctgcatctcggggtccacaacctccacaacgtcctcttcgtcgtcctcagcaacctgattctcttcaacatcaccttcaggtcgctgctcttcctcggcgtcaaagatggcctgcacggtttcgtcggagttctccctaagaatagttcctcggaccttggctcggagagcctttcgaatcttgctgatgtcattgtactcgaaccagccgtccagaacgtcgtacttggctcgaacaggggcactgtggattttctcgtacaagagagggtcagtaatgtcgcacagctgcagagtttgcgactcgggaggatgaattccgtcaaagacatacggcaggggaagtgccttttgagcagcaggctgaacgggaggggcaagaccggccaagtcatcctccaccttctcagtcttttcgtcttggttgtcgctgattcgaaaagcttctgtctggtagaaccgcatgctggggtcagttctggggtcctttccgtacaccacataggctcctctccagggtccagatcggaaatagtaagccacatagggcaatgcgaatctgagaatgtgtttgagctcggggttgttaacgtaatgacgcagtccctggcgagtccaaagaggccgttctctgaagagctcctgcagctcatccacacattgtctgagtagcttctcgtgcacctgttgggcgggtttgccggagtagtcacgtctagcgtctccgttggaagtgtccatctcagcatctggctcaggaagaggggcaagctcttttctagggccagtgggggctgggtctgttgctgtaagtacccaggagtacagcttgggtgcagcattggcgttcactagctttgtagaagagccatctttgacgacagtgaccatggggttctgtttgtagtagtaagggaaagggtaatggatgagcgaaaatcgaggaggtggaattgagtcgatttcgacagatgtgagatcaccaggtccctccagctccagctctttgattctttggaggtctccagcaaacagcgaggcctccaccttgtgcacaaatggcgagtttttggtgcaccattgaaaatcagccatttctcggaatcgttgtgtcgagctgatatggtggcatttgtagtcggagcttttccccgtttcttgttcctgtgccttaagagcagctcgcacgtctccattgtgtttctccagcagttttttcgacagcttgacttcgagcagcacgtgctggtcgtttgagagcaccgaattgacggggtgtgcaaagtggtcttccggtctgaatcgcagctccagcttgtcggagtttttgatggctcgtgccaccttttcaggacctcccagcatagtcagcgcacggtcctcgtttaccacattgatgggcagctcgacggacgccagacgcgacttgatttggtgctttttggcctccatggtgtcgtgatgagtggaggatcgcggtgtcgaaattatttatttgcagcggtgggagtcgaactacagcgcgcatgggggatgtgtactcaaccttaagttagcgcaaacacaagtctcccatccccaaacccgccatgcacatagagtgaatcttgttgcaagtaaataacagtgtgtctcttctaccgcgccagcaacacaccacaaacgagacatttccctgacagatataatgcccaacgtgctggtcatatcgaaccgtctgccggtgaccatttcccgcgaggaagatggcacctacaagtacacaatgagctcagggggcctggtaacagcgctgtcgggcctcaagcagtcgacgaccttccaatggtttgggtggcccggattggagatccccgaaaaagacaagccgcgactcatcaatgaccttgagaccatgttctcgtgcgtgcccgtgttcatggacgacgatctcgccgacctccattacaatggcttctccaactccattctgtggcccttgttccactaccatcccggagaaatgaatttcgaccaggtggcgtgggaagcttacacacaggccaaccggctatttgccaaaaaggtggcatcaatcgtcaaacccggcgacattgtgtgggtccacgactaccacctcatgttgctacccgagatgctgcgtgaagagtgcgagaacaacagcgctctcgacggcctgaagattggattcttcctgcacacgccattcccatcttcggaaatctacagaattttgcccgtccgaaaggaggtgctgacaggtgtgctgtcgtgcaacctcattggcttccacacctacgactacgctcgccactttctgtcgtccgtctctcgaatcctggatctagaaaccatgcccaacggaacgtattacaaggggcgtcatgtcgtggtaggtgcgtttcctatcggtattgatgtcaacaagtttctcgaaggatgcaaacgaccagctgttcaggaacgaatcgcacagctccaggataagtttaagggcatcaaggtggttgtgggtgtcgacagattggattacatcaagggtgtgccccagaaacttcacgcctttgaggtcttcctgtcagaacaccccgaatggatcggcaaggtcgtgctggtgcaggtcgcagtgccttcccgaggactagtggaagagtatcagaacctgagagcagtggtgaatgagctggtcggacgtatcaacggtatgtttggtactgtcgagtttacgcccatccatttcatgcaccgatcggtggacttcaacgagctgattgctctctactcgatatcagatgtgtgtttcgtgtcgtctacgcgagacggaatgaacctagtgtcgtatgagtatgttgcttgtcaaactgagaagcacggatcgctgatcttgtctgaattcacaggtgcagctcagagtctcaacggagccctgattgtcaacccatggaacaccgaagacatggccgaggctctgtacgactctctgactttttcgcccgagaagaaggctgagaaccaccgcaagctgttcaagtacgttagtaagtacacctctcagcattggggcgaggcctttgtctccgagttgaagcggtgttgatagacatagataactatttattgggaggccaggagtagaaaataatgaaatgcaataacgagtgattagattgtacttgtacaggtagctgagcaacagtctgccagttacagtattggtctgtttatgtctcaagttgttctgtggccttttctccatcgtgacaaatattattcatcggtttggatggtcactggacgttgatcgggtcggataaagcggatccggatcacgtgtctcatgcacgtggtggtgtgagagcatggagcaactgcagagaagccatgtttattctgaggtgagcaaggtcaatattgatcagagagaagctggaaaagtcataatggacttgaaaaaacgttggaacgttgtatttcaaagccagagtcattatcaagactattacttcagtttcatcaatgaagatgctgaacagaccctcggtctcgggacgaggctgttgtaacctaataattaaacattcggtttaagttgttagagttttagttgagagaagttgccagctgtgtttggcactgtgttgaacggtctagtgcttgttagagggcattttgtacaaaagaggcaatttataacggctagatttaacagaaacgtttacgggggcttttttctagctctttttgtcgtcgttcagtccaaaaccctcgtatggtggacctcttgaggtcgccccagatgtatactcggaccggctgcacgcagagccaaaccatgcgatatcgaaaatacgagaaggttgagcgggtattgtaagacactttggagacaagcattggtgaaacggagggcatctgaatcaaggacgatcatcgtatgattacttttgtggtccagcgactcagatacggctacagagcgcaaaagtagtgcccatattacgatactaaaacatacacttctgtcgtccaaagtggtattgtacatactgtacatacttatattttcgtactcgaccttgtactgtatctgatttcgaaattagacacgacactccacttttacaaacaagcgagtactgccaatgtctctacttgtagtacagcaccgaatcaactgacagaccaccagccacacccctgtcacctgcatatttgctcggtaccagttctcttgtcagtggacccaccttgctttcaaagtcgctggacgttttcttgtcttggtttctccgtgtgtgcttcgctcttgttcttgcttcttgttggctcttgttggctctcttgttggacgcttatccccgaagctccactccaaaatgggccgataatgtccttcttcagccaacctcgcaggtttcatgcgctcagccgcaataggcacgttaatgagtaaggcagcaaatggaagtccagtcgcaagaggaatgaatataagtatcggtgtggttctcagaagtagccgtttcactttgttatccaatcaagccctctccaccattacaaccatgccctcagctactacccccacctactcggtggacgatctcatcggaccctgcagactgaccctcggcaccatcgaattcatccacggaggctacgtccaagtggacaagaaggacgtgttccacgagcagatttaccacaatacaaaaaccttcatcaagaaggacggcgccgtcaagatcattgaggccaacaagtacgcccccggccctgcagtaagccatcatgccgtggtgctggaagacaagatcattgtctttggaggctactaccgaaagagccactggttcgagaacagagacaactccatttttgtgtttgacaacaagaccgagcagtgggtggacgccaaaatggtccatttccatgagaagttcagcattcccgagaacattcctaacagcgatttggacactcctcgaatctacattggaactcgacgacagctcaacaacatgaagcagtgcgaggaacattgtgtcagccagccaaacggccactctcttcacgattaccaaatcaccgccaacaacaaggacctggatgatgtcgtcaaggttggtgtcttctcctccaagctctccgaatttcccaagttgcttgataacatggataacgtctccaaaacaatccatatcgaccagcctgccgaatgggtggaagctttccaacagtatactctcactggagttgttcctgacaactttgaccagctctgtggccttctgatcatggccaagacttacgaaattgaagatctcaaggtgaaggccaccgagaagctgctctctatggatcccccctgtgcctcctcggccattgttggatggtacagagcctactgtgcaggcaaccgcaagattcgcaacaaaatcgccaaggactgcttgaaatttggcaaggaatgtgccggtaaggagatggagatgctccagacccaaggattgctcgtggacttcaccagcgacatgtttgcctaactcttctctacataattaccattaatttatacatctgactcgataaaatactcgttttcgtgtgagttgttttcaaaatgacattatgattagtaataaatagatacataaatagcaccttactgcttctttcgtcgccatcggaccttggacgcaatcttgtatcgcacgccaggaactcgaagaacgtagtagagcataaaggtggcacaaacgttgaagatgggataggcaaacacaatgccaaagtttcgccatcggtctccatagaaaatggaggcattgtcgaggtaggcatcagcgttctcgatggggcaatagtgacacatgtcggtggcagtttcattgagcaggtagcccttgaagatgccagcattgtccaggaagggtttcatgtactgtgcacaagagttgcccttgagaggcttgaactgcaaaatctcatgttgcgaacatgtcacctttcctccggccaaaccagtggccatgaaaccgccaatgaagtatgtcagaggcgacgctcggtacatgaagatccagaatccaggcatggactccttcgtggccagcacaccacagaacataagacagaaggagaagagcaggtatgcaaagttggctgccgtctcgtggttgttgaacatgacaccaatcatgtgagcgtaggtagagtcgtaaatgaagaagaccagcaggaagaggaagtagagagctcctcgctcctgtgtctggtggttctcagccgcaattcgatagaatccaatggggtagtacatgcagaagaagacgacaaccgccacgataatctgccagggaagctccgcgagcatatttccgccgaggaacacctgccacgagtaagtcttggaagcacgctctcgagcctcgtacaagtctcgctgaatcatgaaaagaggcataatctgctcggcaactgtggtgaaaatcaggaacatgaggaaaatactaaacatttggttctgaagaccctgaatgtctcgagccgacttgtagaaggagaaaccaatgaacagagcacaaccaatacacagagtcatcttggaccacagataggagggagttcgccagtggaactgcagcagtcgcttggtaacgtagtacagctgggtccactgagacacggcgaaatcagtgtcttctcctccaactgcaagagctgcctgagagtcagcgttgaatgcaagacgcatatcatcgagttcctcacgctgttgtcgtcgaagctgggagtatcgccagactgagggccagtccttcttggcccgggaaccaggagcagcaccaattacctccagcatccattcggcagggttaccgttatcaggacaagggtcagcaccgttactttcaaagtattcaatgagcagagacgccttatcaccgaggtctccgtagtacactgtctttccaccggctgccaggaacagaagtcgatcaaactcttggaacagaatggcagagggctgatggatggtacacaggatagcctgaccgttggcagccagctttttgagcagagagacgatagaccaagcagtctgggaatccagaccggaggtaggctcatccaggaaaagcagcagctcgggcttggcagcaagctcgacgccgatagtcagacgctttcgctgttccacgttaagaccttcaccaggaacaccaacaacggcatcagcgtaagaatccatctcaagaatagaaatgacctcatcgacgtaagccagcttgtcagctcgagacacagaagagggctgtcgcaacagagctgagaactcgagagactcacgaacagtggcagtggcagtatgcaaatcctgctgttgaacgtatccggtctttcgctggaaagaggcgtttcgctgctggccattgaccaacatgtctccatgaacaataccagtggattttcgatcagccagcacatcaagaagagtagtctttccagcaccagaagctcccatgagagcggtgagggtaccgggcttcacgtaaccgtcgatatggtccagcaatcgcttgttctcaccagcaaccttgatatcgtagcaaacatcggtccattggaacactccagagtgctgcaagttagatttggacgagttgagagacaggttggtgcgaaccttggtgggaatgtagtttgtgtcatcaccaactgtggggggcatgtgaacagtgtctccatgagggggctcgtacccaccagtaataccaggggtgccaggagtgttgtactgagctggggtggcgggagtagtgtactgagctggagtggcaggggtgaagttcacctggggcgcgggagtcgtgtagttgatgtcgtctccaacggtaggcggttggtgaatagtgtctccatgggggggcacatatgtaaaaccgggagtcatcatgcctgcgggtgacatgggaccaggcgtcatcatttgctgaccgggagagaacatttgctgaccgggagaaagcatgccaccaggagtcatggggacatgcatcataggagcgggagtcatgggagcctgctgggcgtaccgagaagggggaatctgagcctggatgggttgctggtaagagtacgtcgagtggttgtcgccgaggttttggtccaagttgtggtcgccgaggttgtctccaagctcaacgtcttggaatcgcttgtcaggcttggccttgaggttctttcgatgctgggatcgcttgaacagcagaacctcacccttggactgggccatggtcacgtactcggcagcaagcaggtagacgccgcagaaaaagccagcaaaggcccacagaatgcccaggtttcgccacaggtgtccagtctcgtacttgtaggccgtgctgatgaacacggagccatcgacgtagtcctggccgagcttggcgccgatagccacacaagacttggactcagcgggcacagagttgtagaaagaccgggaaggaacgtaaagtccacaagggaaccttctgtttcggaactcgttcaccattactgcctcaaacgcataagcaacaggattgaggtaattcatccatcgggcccatccatgcatgtaatcgacgggaagcgtgaaaccagtgtaaataaccagtgccaaaactagcacagaggcgggggccagagcctgttccatagtcttggtgacagaagcagtgaaccggaaaatcatggacattgccatggtacaggtgaacgaaaagagcaggaagatgaagaaggcacccggggttcgtctcaggttagtcatgaagtaaagagcgaggttgactgaaatcagagttgccagtttggtcggtaaatcaaccaacattgacgcgattgattctgcaaagggatggtacaatgcatatcgtttgtgtttctcaatcagtggtcgctgtccgtacagcacgaaaatctccaaaacggaggccatagcgttcagcaacatggccaagaaaagcagggcagatcgcgagaagaaggcatcagtcgactctcgcaaattatagtacattgatgccagaatgagggccatgatgaagttaccaatgatggtcatcagcgtcatggacaagtctcctctcaccaacaagaagcctctccagagacacagacgaacctgcatgggccaggagagcagatatggcgacgacagacgggtatttcgggcctgagactcctttcggagcttcatgaactcgacataaccctgaccaccaagaggatgagtggtattgaatcggtcgatgttgtaaactaacagagcgtgtgttcgggacgatctccatcgagactcaaactcctcgggagttcgaggcacgagcttctcccatccagccttgattcttcgctcgacagggtttgtaagggaggtcagaaaatcaccagtggtctggcgatgggctcgctcgaatcccagaccctcaaagtatgatgtggcctctccggccttaccgaagaagatttgtcgtccctcgtacagcagacacaccttgtcgaacatgtcgtaggcctcctgggaagcctggtacagagacacaaacatggaggcgcctgtcatctgggcggaaagtcgcagagatcgaatgaattcggtggcgttcgcagcatccagacctcgagtggagttatcccagcactgtagaggcgctccgcagacgacggactcggcaatagagactcgttttctctctccaccggagactccacgcactagatcggatccaaccttggtgttgattgtgtgagacagaccgagagtggccatggtaacatctcgggtgtgacgagcatactgctctcgggtcactcccagcactcggtttcggggagttcgggctagagccgcaaacatgagggtctgtccgaccgtcaagtgagggaaatggatatcgtgttcagcattgtagacaatttctcctcggcaatgctttgtcatgacatctcgtggtacgcctgcgttagtagggtcattattggttattgtttttcgcgctccgcggaaatctgctttctttgttcttgtgttctgattcccacctggtatgattatcgcgtacagaacactctattcgggtctaggtattagataccggccgtgttgggagtgatctgcactgattggaatgtgtgcaacacacaaaaataaaaaataaaaaataaaaaaataaaaaaaatcaggtggacacaaaataacggccaacaagaaagaatagaccacctggaagatgttcattccggtatttccatctccctcataacctcatagccccataatcccaaatactcaccctgatagttccattgtgtctcttcctccacatgaaatccgtacgtctcgcaagcaatactcttgagaaatgtagtgcatcctgatccgggacgtcccagaactacacaggtttcacctggaagcaccagtccatcgcacttgcgcagaatctggattttgcttgtccgtttagcgccaatagcacttcgcagcaaatctccagtggccacaatgacgttgagaaacgtcttctggtagtcactgcgactgccgtacccgtaggcacccaggttcttgaacgacacgccggccgtgattcccttactgtttccaaatcgctccttgagacccagcacggtcttgatccactttcgcgagttgaactcgcccgaccagggatccagctccggctccgcactggcctccacgtaagggttgacgtcggggttctcaaaagacgtcttccgcagcatatcatagtcgtattcgtcctcatgctcttctcgaaactcgtcgtcaaaggtgtggtcgaaaatgtatcgcgattctcgatggtgaggtttgtgtaccattccctcggccagcgatctgatctcgacatctagcgagtcgaagttgccgaccgacgacacgcccgacgggtagtagtgcgccatgattggtgtttgcgatagcttctggagtgaactttcaggggggccatttactatatattgggctcttttttttctggccgtgctctctcttgttgttcaggcttcagtctttaggcttttttaggtgggaaagcatttgccttgtttcgcaaccttgtctgcccacataagctcttatgattttgctagcttcgttgttctggccaaaaatactgcatttcctaaattcaaactggcctgggtgacagacgataagttggcgatctgcgcaagttttagttaggggtggagtagcaccggccagattcccgcccgaatctcgggtgagtggatccgcttgcccatctgtgcctgactaatgcgttggtggggctatcagccttgcaaccgcgcgcctttagtgccccgccaccacgctcgttaatcacgtttgggcccgattgttaggcgtgagcttaaaaatgagagtgaccgaattatgccgcgtcctctgcgggggggggcaagtgcaaggccagaaggaggtctgtatggagccgttgaaagaagggaaaagacaccaaaggtctttggcctaccaaaaaaacatgtgtctggacattggtcaccctccaaatacggtcccctagggcccctatagccgtcgcttatcgccacgatcccacatcaaggtagggtaatccccccatgccagcaatttgtctgacgtatggtgcatttcgcttgtcacacttacggttttccctctgcacatagacattccacagcagggcatacaaagtggtgcgggggggggcaggagggaggaggtttgacgataagtgtcaagattacgagcccgcatttgtccggactgcgacagatgagcaactgttgccaactgggctggtggtcataactggccctacttggaccggtcatcatgttttcactgattgcgtttcagccttgcattccaacactacgcgttgactaacctactcggcctggccaacggtgtgtccctaccagccctttgctagacacggttgaagtccgttccaactgagctgagatttctctgcccagactgccatgctacggtatttgaactcgcactggagctgtaatacacactgcccgcagcatgagcctgccattcacgtcaaatgtctcttttctgcgacacaagctcccatgtctcacacaagtgtggggtgcagcccttgtaatgaataatagctagggtacaaccccccgatacgatattacgacgctgacaccagaaaaaaaagtctctggagcgccgtggaaggctggggatggatcgtgtcatatccagggcagcgttacggtttcccgagcagatcgtcggattgccatacgaagtccttctgtacccgcgtatgccgccttttcttggttttgctttcttgtctcgattttcttctttcgcttgtccccaaaaatagccttcccaagaatgccaaaattaaaactcacacgttagagaggtattgaacagggcaatataagacatggaggaatgtggtgtaccgcaaacggcagcaggtatttgcgcggagattctggagatggtcgtatattttagatggttggaggatctgccgatcacgtgactcactcagtcatttgttgacagaacgactactgtgcacatgtacactctcgtacagtatgtccagtgcactctatctcaatgccacaattgaacgtcgatctggcgggtctggcgagtaattaacaggtacgctaccagtaagcgaaaagcggaagcaagcctaacggtacagtaatgaagaaagtgcaactggatatacggtaaacctcacctgatccggaaaccacaccgattggcacctacggtggcctggtacctacttcagtgacagtcagttgcagttgaggatgcagttggccctgcactggggggttcgcttatttcttggcaagaataatttaagaaataatgagaaggctgagtattgtcactggtgacacctgagaggtttattagtaattaacagggtcacacgagctcttaattacgaaaccaattagtcgctcacaagtatggctgtctcggaaggcctgaaaattatgaaaccaagaaaaatccacctccacggtcctatctgacgcatgagttgatatccaattgtccaataccatacacgactttgcggggcttttggatctaatctcctccaccacccaccctgaagtgctctctactatctaattactcaatatgatcgacaagagtggcccacgtggagtgtgcctgatctgcagttattgaaccctgagacggtggggtccggagcaaagcaaactatcccgcgcagtggcggagcgtttacagttgggctagagatactttggtaccggatctcggaggcccccgacttcctgcttcctattcccgccagcttatcgtaccccacctctgctcagcccacctagttccgatgcaaggacgacgatctatgcaccaaagttccatcgggctacaagaacaagcaagacaaattaaaaaagacaaagaaacgggtggggtcaacggtacgggagtggggaacacaaacgggtgggtctacgtcggagcgttgtgacatcatgcttcacgccaaatcccctgcaagacaacagccttctgtgacagacatgcggcgggattactgtaacacttagttgcgggtactgtaggaaaaccaagtatccgaatccgtacttgtcgccttggccatatatcattatagtccaattcctatgcacaaagctctctctctgtctacaattcacacacaaaatcacagtattgtacaggtatacaaccttcttcattatctacatatcgtcgttcgacgggactcctctcactcaaggtgagggtctcacagtgtgaaacggatttgactaggtcaagtacaagagtctggcggtgctgggctttgcatgtctgtgtctgtggctgtgtctgtgtgcgcagtgcaatgaagtgcatcttcatcgcctctactcacccttctgctgtccagcccagatctcctcggcctcgacaatacaccggttgtttgccatcatcttgttgatagtctcgacatattcgtcgtactcgtcagaatcgaagacaatgcctcctccggcctgcaggtacgcaacaccgtccttgagaagcatagttcgaagagcaatgcaagtgtccatggcctctccgttgtagccgaaagatccaacggcaccggcgtagacacctcgcttttccttctcaagctctccaaccagctccatggccttgaccttgggggcaccagaaacggttccggcagggaaaatggatcggaaggcgtcgaatcgggtctggtcgggtcgcagaacaccagacacctgggaaacgagatgctggacgtgcgagaaggtttcgacacccaaaagccgatcgacggaagtggatcgaggatcacatactcggttgacatcgtttcgggccaaatcgaccagcatgacgtgctcagctcggtccttctcagagttgagaagctcctgagccagctggttatcctcggcaggagtagctccccgcttaaccgttccagcaatgggatgagacacaattcggccgttctcaatcttgacgagcagctcaggagaagcaccaacaagctggaaatcaagatagtcaatgtagaacaggtagggagaggggttgacggttcgcaggtgtctgtagacgttgaagggatgcaggtcggtgggccgagctactcgctgtgagggcacggcctggatgatgtctcccttcttgattcgctccttaagagtggtcacgtgctgttcgtaacccttctggccaatgttggaagtgaaagtctttccaagggtcacgggtccctgggggggctggggaacctcaggggaagtcagcaggtctgcgattcgctgcacctccttcttggcgtcctcgtaggccttggtgagatcggtgtcggcctcaaccttgacattggtgataacctggagtcgctggtagacgtggtcaaaggccacaatggtgtcgtagagcatgagggcactttcggggacctccaggacgtccttgagatctcgcttggttcggggctcgaagtacttgatgcagtcgtacgaaatgtatccgatggctcctccacaaagagtggggacgccgggggtctggaactgtcggtactggtcgagttcagactccagcaggttgagcggatcaacgtcaggtccatggggagcaccagtcttgatcatcttccggggattagatccaatgaaagagtatcgggacagatgcttaccaccgagggcagactcgaacaggaacgagggacttcggttggggtcatccagacgagccaacttgaggtaggcagtatgaggagtcagggcctcagcatccacataggcgaaaacgggatagaggttgtcgggaagagtctccttggtggcggcggctcggttgtcggccacgatggtctgaagagcctctagagtgggtctgagttggatcattgtggagtaagtgaagccgttgagctgtcggtgttacaacgcacgttttactggtaccggatgactctatgtcgaggaaagtttcatacacacaaatttcaaatagggttatggtatgaatcactaagctactggtaaggggactgcggctatacactgttagtggagagctaaggtagaggcgttagtggcgctagtgggggctccgtgggggggactttgttgtgtgtgtgagctgttggtgagattctccatgatgtctactgctctgtcttttcattgcagatgtggggttatgcaagcgtggtcactgggtgcactgaaattgtgttgatgtagcattgtagtattggggaatttgcaatagtatcgtcagtacaagtgtgttatgaactactattgggtagtctggtaacagtatgtactgttgcccggaaaaaaacccttgggttacccagtggttgttcattgtggtcatgtaatcgttattgggctgtattcacctctcgttcgaccttgccacatcagctcttctcctttttttttttttcttcagatttgtatcttgtagatgtcattttctcctctaaaaagacaaaaagtccaactaaaactcttggttttctagttgggacagctgcataaaatatgcactctggttgtgtcacaccaaacatttatttacaccactttaatcaacccatccactactctgccatcacccaacaatggacgcagcgtcggtactcgaccaatacgtccaggacctggcgaacctgccgtccgaggtcgcacacatcctcgaagaggtccgagacaaggatctcaagttctatgagacccgcaagcgcatccaacaacgcgacaaccagattcacaaattcatcagagcaaatggctccctggcagaaaacccaaaggagcaggcggcataccccaaaatacgccaggacttccagaccgccatggagcttcaggacgagaaatgcactctggcagcacaggcgctgaccctagtggcaaaacacgtcaagaaactgaatgacgacatcgacaagctggatgccgagggtctgttgggtggcgcgccaccacagaaacctatttcagccaacagatcgcgtgccacgtcatcagccactcctgcaccggaacccccatcccgaaactacacaagagacagagccaacagtcgaagaggcggttctccagcggccagtcggtcttctactcctggaacacgaccgccaaagaagcgagcgactgacaagaataacgaggctgcatctatgagcaaggagtcgtctgtgggtgcctctgagcagctccgaaacatgcctgagacggtggcggtgggatctctggatgctgctattcgagccggacctggggaagatgacgaggtgctctactgtttctgtcagcagccgtcattcggagaaatggttgcttgtgataacgatgactgtcagtacgaatggttccattacgactgtgtgggtctggcagagcctccccagggagtctggttctgtccttcatgctccaagggacgaaagggtgataagaagaagcgttaacagatacaattctggagtttgaaaccagcttcccactgttcttcaacgccttctactgatcttcctgaagccgagccgcagggcgcaatttccatgtcacgtgcccccaaatcacgtgcccccaaaaatcgcgtgcgtcgcaggctgtattccaggcgtcatgaacgctgcgattgagcactgtttccggggcttgtttagtataatcataaagggaaggacatgttgatcgtttttgtatgagccccaacagcgcccttacgatgagatccttcccaaacttgtagtaatatattatttatttgtctctatggagcggcaactgtatcagctcttttcctcgccaaaatacttttatctcgctgtggtttcgattctcaagacatcgtcacccgcctcgtcaaagtgttatcatggacgtcttcgacgatcgcttaacagtggtgttcggctctcggcatgtccgaagaggaaagactgccctggaaatgcgtacaagatgcgaggtgactccacaagaggaagtcacagggtggagggacataaacagtgcggagcggctatacgaggaatacgaagaggcgcgcgcgtcatcgtactggcggggtgtcttgtgagggttaaatttggtgtcgaaaacaaaacctcctttagagacaggtctactggtggttcgcgttctttttggtacctcgcgtttcacagcgttccggatatatccgattatctccgagccgagatcgggaagggtctcacaaaatataggcgaacaacacaaagaaaaagaaccccatcagagcacgtgatgccatagcatgcttgtgtggtccacgaggtgagtgcgataagcagaattgtcggcgtgtgccgtattaggtgactttgctttttccgccgtttgtttgtttgttcgtgtctattggttggtcgacagaaaacagaaataaaaacaagaccagtgaggaggatctccctgttgaaggccctacttgtgctgtaaaaaacttcaaaaaaaaaaaaaacagtagcaggggaaaccggctcacgtgacaaggttaactaatacccctcattacaccgcggatgcatggtgtggcgcaaacccggcggggtcctaggcaagatcagaggtggaaatcgggcattggtgagtagtagaggcggattccgccgccaggcagctcgtcgactgctgttctgcggttggggctagcaccgacgacggtcacttgagtcgccaattgggtttctggaaacctggaaaagggaatagaggcgaaggctaaatgcaaagcctgctgacacgacagttaccacacaccacaccacagaagactctacaacagaaacaagtgtcaacatcatctggctcgcctcgcaaatcagtacgatacagagaaaaaaaaagaaccttcgacagagaaaaagacatccttgcctttttgcccccctcagcttcttttcgacacccctattttttgcgccactttctggttttgattttttgatactcacattgatttatctctctggtatcaacaaacacacattttcatcccccatcaaaacacggtaatacaacttccagaatcacataatgggacagattttgtctacgcctgtgacggataaagtgagtatcagctgtttggaccccgcccgaccatgtccaattgcactacttgagtgtgttgatgcccgttttcctgggtagcaacgttgagcacccaacgcgatgactgacacgggaacaagcgacggcgaacattgaatgaggcgacatctcccctaaacaacaactaacgcagtactctgaaaaaggaggagactccgatctcgtctacggcctgtcctctatgcagggctggcgagtaaccatggaggacgcccacgccaccgtgctggagctcaaggacgccaagggacagcccgagaagaaaaaggtggccttcttcggtgtctacgacggacacggaggtgataaggttgccatctacaccggcgacaacctgcaccacattgtcgcacggcaggaggcctttgccaagggagattacggtcaggcactcaaggacggtttcctcagcacagaccgagccattctcgaggacgccgccctcaagcacgactcatctggatgcaccgccaccaccgccattgtttccgacggcaaggtcatctgtgccaacgccggagactcccgaaccgtgctcggtgtcaagggtattgccaagcccatgtcctttgaccacaagccccaacacgagggtgagcgaacgcgaatctgtgccgcaggaggatttgtggaggctggacgagtcaacggaaaccttgctctgtcgcgagccattggtgactttgatttcaagcggtcaccgtactttcctcccgaggagcagattgtcactgcctatcccgacgtgattgagcatcagctgactgccgacgacgagttcctgattctcgcctgtgacggtatctgggactgcttcctgtcgcaggaggttgtggagtttgtgcgacgaggtattgccgagaagcagacccttgtggacatttgcgaaaacctgattgacaactgtctggcccccacctctgaccttagtggtgttggttgtgacaacatgaccgtcatggttgtggccctgttgcagggtaagaccgaggaggagtggtacaacatggttgccgagcgagtgaagaacggcgagggtcctgccgctagccgagaggcagtggagcgagttgccggagaggagcgagaggtgactgcccagcagttgcagcagaatgcccaggcccagcaggctaactcggcatcgctggctcttcagcagttgctttcttccggtgccaccatcacagacgagaacggcatggttgtgctcaaggctgagaatgctgccgagctgcttgccaaagtgggatttgctcccgaggacgttggacaacttgtggagagtggagatctggtcgaggaggatgtcgaggtcggcggtgacagaatcaccgaggagcagtgattatttaatgatgtacatgatacaattgtttagtgatgttttctatattatatttgtgtatctatgtgtgcgttggtgtgtatgttctatttacttttcgaggttgaggaacttgagcgagttctcgtaaactaccttggtgagctcctccagaggaacgcccttcaactcggccataaccttggctaccagcacaatgttggcaggctcacaccggcccttaatcatgctgttctccacgaatttctccttctttttcgactcatagggtagcttgtgcccttggagcagtttgtgtgattcgtgcgaaggtcggatctcgcaccatggggcatcagtttcaagcaacagcaactccagggggatctccttggccacgtccaagttctccttggtcttgagtgagcagccgttgataccgatgtaaaggcccatcttgacgtgatcctggagctcgtcgagggtaccagtgaaagagtggaccacgcctcctctgggaaacttgccagccttcaaatagggatacagcatgtcgcagaaatccttgtgggctgctctggagtgcaggaacagaggaaggtcgagtcctgactcggcaaagagtttcaactgctgctcaaaaaacagcttctggatcttctcggggctgaaatgcagtcggtcatagtccagtccaaattccccaagtgcaagcagagtcttggggttcgatctggccacctccagcagatcctggattcgtgagccgatagcgttgatatcgtagtctccctcagcttccgtagccttctgctttcctccggtttgggcgttgtattctgctagggctgaacaaggatggattccaccagtgcagtagagctccagatagtcacagtggaagtcattgcagatcttgaccgactccttggtttcggaaagatctgtgcccgtgactaggatctttgtgagcttctgctccttagctcgctcgagcacagcattgaagtcgctttcatggccctgtttgccatggtagataccctggaattggggatcagacaggttgacggcgatgtcgatgaacattgggtgatttcgtgacgttgtgtagcttcttctgaccacgtttgacactcgtgacagtctgagaagtctcaagctcatgattgagttttgaaccagcctatgctcgttaatgcatgtatgacattacgaagagaaaggtcaagggcaagaaacagccggtgacaacgcgatgatgcggtaagaaacgacaatcatatgctactccttattcgatgcaatccaaaagttatcgtcatattatacgagaacaggtgcatcattgggattatgtaatcagattatgacttcttttagataatatatgacgtcacatctggatctagccccatttaatattgggtcttaataacttgatctatccgctgttgggtacaagtactaattaattgtatatatcaactgatatgttctcagaccaggctcgtactcgtaccgtacatacaataatgcatatgctgtatacatcaaaacagactcccaatgtgttgctggtgggatggacatgtccaaatgtagccatacaagtactactgtacaaacatggggttgagaagagtgcgataacattgagctgggatattccgtgtattttgcatcatatcaaaacctccaaatcgcccattttcgtttgcttttctcgcgatctgcgttgcttgtctctccagttggtgcccatacagcatgtacagcatgggcgttacatcagatggtccggccctgttgtgtgcatctttctatgcggaacctcacgatattcttccggtattggggacctgcacagaagcaattccagtttctcgaacctcggaatttcacctgtccaagtttatccttggagacatggccccacgcctctttgcctcgaggctgcatcacgcgtcaaaaagcgatgcatccagccctaaagctgaaaacgctggttttgacactgtgaggtgagacaagaggctgggatgtccacaaagagaatgtcagttgaggggacaatattatgtccggtccggtgcgttgcgttattatggtgtcatcaacaattggcgctaagattgcgctttaatcgggggtgtttgtgtttcctgtatctgctaaatctgctaaatactcggaccaaacacactactgtccagggctgtactgtatgtactgtaagttttagttaatatagggtcacaccatctggtgcagctcccattttcaaagtggtggtcaagctcaaatacacttgaggttttgcttcagcatacattacattagagctaaagcgcaaagggaggaatggggaatgttggcaaaaatatggatttctgactggattaggacagtatttttttacgcaagaatgtaccgtgcaccattgggggatcctgggcagttacgggtctattttgcatccagtttcagcccgtgtctggggctgaaacaatgcgttgccttcatactctccccaccacaaaagtctttgtttacgctttgcaccgtctcgaattttaaggtcgctaaaagtctgaccacttacttctctttgctaaatggttcacggcggccacttgtaaagataaatattttgcatcgttcgacactggtagctacgactcacaatcattgctacaccgcaccaacaagaaacacaacgacactaaccaacacgcagcatccgacgtcaggcatcacacacagacttgacactgacataacacgggacctagacaaacagataccacaagccgcaagcaagacaggtcacccagacatttcacactcacaagacacacacttagacacacctctttttttccgccatgcaatggtttaagcgaagcaagcaggcgttgagcgccgatgagctcctttcgcaactacaggacgaccagcaactcacctttgcgcagttcgccgtgattgtgaagcccttctcagctcgagacgcccatgagtgcaccatggcattccgaattctgcacaccattaacgccaatctcaaagaaacacaaagctggccgttccagttgctgcgacattgcgacctggaacatgtcacggggaagtcttcgtggctcgatcgaatccgaaaacgaccacaaaagcccacctccgagggaggcaccaaaacagcattcaacatcaacattgccaacaaggtccacaagcagtgcggccaaatgaagacccagatgcagcaatgggacattaaacacctccagaatgttacaggcaagcttcttaccaacggaagctttacctcggacgcctcttcggtactcatcacacttgtgctcagaatcctttcacgatactcggaactggaggaacagctggatctggcaatgtcacgtgccaccctcattaagatcaactacgagctcacagagaagctcagcaaggagctcgagaaccagggagaagaggaggacgaaataaaccctctgcttgtggcctacagatcgttcgtcaagcaactgctctccgagctggacactgatagcgacaacagacaagatctgctgcaggttgtcaaggacctcgaggacatgtacaagcagtacgccgcctccactcccaaaaaatcctctcctcgaaagaagtcctctacttcgagattccccactccttcaactcccaagcgagaggcctcggaccccttcgattacatggactctcccactcacacacagacggaatctttctcgtctatgagcaactcggttaactccctattctcttctacatcgaaagcatcctccactgtcagtgacgagcttcctaacctcctgcatgcatttgacatggaatacgtgaagcagcagcgacagcgacgagagctggacggcgttggaatgtcgtccccacagtccatgacctcttccatctcctccaagtcgctctcttcttccaagtcattctccaagctcaaccccacacactcttcacctctggtggcggcatctcctcttcagacttcgcatattgccccaatgcccaattcttcacctgcaccctcgcatcttgacgtccagatgatcaacaaccgaatgatggtcaaaaccgcttctggttaccaggacatgcaggagtgggtcatgaagcagaaccaggaggctgctcttcgaaccacacagcccgccgtgaagagcgcttcggactacattgtcacggttcccaaggaatctgttcctcgaacccttccttctacaggcacttctttcctctccaacatcttcggaaaccggcctctggctccccccgttcctcttgaaaagaaggaactgcctaagccccagccttccgtcggccctactacctctctcctagccaagagtctttctgagaagcactctaccttccagcaatctgcatttgagacctcttaccgacaggagatgaacgattttgagtagagcgtcgaccaaactacgatactacaagtagctcgtgcatagcattatttatttccgtgtgtaatacgataaacaatacaaacaaaacaccatacagtaatttgttttccccttttgtcgtagattattattatggcaccacgaagttgggtgatcgtgcatatgcgcactgcaagtaactgtcgccttatgttttatcccgtatatctgtggtctgtggggtgccggacattgtttacttctgtccctcagttgaaggacaggaatgtacataaaattactgtacagttaccagtaaaaatacacacaacactcaataactataatctgatataattaataaataaagacccctggccagttggagtcaaatgaagatgtatacagctgggctgctccggtatatcttcgggattaacacttgttttgaggtggcgccatgatcgccgttaaattaaaacctcaaaatatctcccacaaactcccgtttggtttcgttcagagcgaccttttagattgttcccgaaagggtgtgggatagccatccagtgctaaaggtaagataacacattgtgttatgtttgttcgtagtgaggtccttgtagacggcctgccgtctaccagcccttcttggggtttgtggccatctccactctcatgaggttgactgttcgtgcgtggatggcgagacgatcccacggaatgagtggctccaacatggtcacaatgtcgggaatatatgtcgtgaagcggtactttttaatgtattggttgatcaggtcgtcataggtcgtctcatcgtccatggccgtgtacgcgaccggcacatggtgagtgaatgtgggtttttgagagtgtagcactttgaatgttcgggtcggtgaaggacgactggggggagcctgttgcacagcagcgcatggttgtttatatatcttggagtgtaccccacaggtttgtcaccagagtatgcagacttggtacctgtacgaagcaggctgaagtttatttgtgcttttgctttggttttaattttcccaatgcgattattgcctctttgttcttgctgcccaactacatgtgccagcagcagctacgtctagtccgtacctgaaaatcggacgatacgttgcgatgggttgctattggggctgtcgggttgtggacggtggcgcgtcaaactcgatgtggtgccttcccgacggtgatcgtcgccgccaatccttctgccctcttaatgccgctgactcctcatcgctcaagagttagctcatggctcagccagcccaaccgaacttaatgcattccgggtcggttcaagtggagcaggcgtatcagacgaggatttgccaccggatttggcgccgcttgggcttggtagtgtgggtccaaagcgcccatagtggtcccctgactccattttcattaaattatgcaatgtgttcctgcattttttgcgcataccgtggcccggccagctcgctccaccatccatccaacccctcccttcgtctccaccacgagagatggtatggtgtcttaattttgcatgcgtcgtacaaagacttgaaacatgcatgttttttggcggctcgtcaaacagatgatacgctgctgcctgtgcgcatgtaacgccactacccctgaaaacgccattgcgcaatactacgcgtgcccgacaggaaggcctacatgtcatgtcagtgccgtcatgtccgggccggctccgacactctccgagaaggggacctcggctttcggttggatacggctaaactcagccatccaaattggtccgtgctaatctaccttcttttgcttgctcgctacaggtttaggcattcaataaggtaaaagatctggcttgaaagtgaaactcctcccgcccggtaactattgccctaacacccctgcgactgagacatgctgatatgtgcatgaacctcctgagactcacatgttgaatagcgcggccggccagaccataaggcagccaattcaaatgaaaacctgcatgtgtaagtgtgggctatatgaccacttctctctctctctctctctctctctcattttgcccatcaatcaaactctctgatgtacgtcaactacctagttaagtaatactcaaaaaaattaccctataaaccagctgtttagaaagtcaaacgtgccgtgctcatgcttccatccgcggctgcaccaggatctcctcaaggtctttttcaactgctttttgatcctctccatagtaataatagtaccaccaggtgaatctgttctccacaacttttggatctatgttgcggaaccgcatctgtgcatcacgaacaatttctggcagatcatactggactctgttgctaagtatgaaccgaatagccattgagtcatctgctgggccccatgtcattgtgcttttagaaacgatgttgctgtaagttgaagggaagctcatgcccttccaataaaaggaagcagcaccttggctacttatatcgctccgctctttgtatcaagtcagctaagcgctggagcttacggccttgtacggtacgattgccagtagtaataaaatatcgaatgaggtccatattgattgaacacaatgtctataacctcgaatctctcatcgtcaactactgtaagcacatgtcaaaataataaagtgcgataatctcattgtagcatcgacaaagtcttcgaagtcacaccgagtgtttcatctcagagaacacagcacacatcaccaccgcgaccccgttaatcggtccacacgcaaccccctcacgcgacagcatctttgcttctagagcctgcgtgcgtgaagtgcttttgcgagatacgcttgtacagtagctacatactgtctactcctgccagtggttcatagcaccacactgtaaaacctgtgagtttttaactctttgtgggttagacgttcaacagttgtttatttaatatcgacctttgtattccgatggcgacaggggtcaaattccaggaatagcacgcttatcttgttctctgagacacctcttgtagcgtcccccgcctgcccgcaaatgatgatccccttgttgtgtccttcagtatcagcaagcgaatgcgtctccactaattacgtcatttttgccgcttgcagtagcatagcagcttagtccagaatctctcactcctcggatttttggacgatctctagtggcgattttaacctgactgtggagctatgctatcccactatttggaaaatttagaccgacattcaccctcctgtcctttcttcgcgttgaacgtttctggtagggtagaattgctggctgaagctgttggactcacctgctttcacagcattgattccatacaaatactcgtacaataccggtatgatacccacttgttcttaacatgacgtcattcgcttagatcgtcgtgcagttttgaagcgcgtcagatgaccataaataataataaatgctgctaaactagaccctgttctcgtagctgtctgttgcaccatgaaaatacttattaccgaagctcgaaaccgtggaaaaataaagcaaccaaaccgattatcgtgtcaccgtacttcgcatcggacttgcgccctcaacacattcccagaagagcaaaaaaataaaaaaaattactccgataccgggaatcgaacccgggttctccgcgtgaaaggcggaagtgataacccctacactatatcggaagaattcaaatttttaataaatttgaaatagactatcgttatcgtttgtcacgtgatcatgaatcaaaaacggaacataaaaaccttatggaagtagcgagacatcatctgttcctatcgcgcacagtggcaactcttttggagcaagcctgtatgtcatcgttagagaaaagtcgtaaagtcgtgtacatgtgacaggcgtcttttggattggaattattatgaaacagaagaaaaacggcaccttgatgattgaacatctagattgggttagttattggagcacaagaattcccatgagtggttactgtagcatttccgatatctacttgagctttcctaaaattctgcatttgtgttctattctatatattgatttggagggctcctaatggctttttcatcagtattgagctgttaatgttgacgagtctctcagctgttgcagaagatacggtcacttcgagagacgctgacactgctgagcaaaagcaaggaagtagtcctgtcttgcacaagcggacactcacttcactcctaccaggactcaactcgagctgttcttgttgtcgagttggagtcagcacacctctcttaacgcatctacgggatggagctatgacgagcaaagttcgcattcccagtatgatcaacactttggggtcttctctacgagtcctgttgcaattcagtattccagaagttgttgagtgagagtttcaggctccctctacgacgcaattgttgagactgattaaaaccgtgtgaagaacgcatgagcgagtaactaagacgtgaagctgcccgcgagctacgaagctgccgagtgaaaggaagcccttcggtacatgtactatggtaaggcagggtgaagacgagttggaggcttagcaagtccctcatgaattctatctccgtggctatgaagctgtgatggacacgaaatattgtccatgaattctccgaagggtagctccctagggtgcaagctctgcataggtaacaatgctttggagggatggactgtcgtctaaacagtcatatgtctcccccaccggctgttgacttggtatcggcacaccaggaatcacagttaagagaacaattgacacacgatccgatcctgatccagcttgctccgcctgagcataagcgtctgcgaagaccgctattgtgcaaagcgttcgcgcccaaccaaccaaaccgccagagcagagctagtccgagccgcaacgagccagaactagagcagccgactgacaaatgccgcccaccgacaattgccgcccaccgacaaatgccgacaaacaacaataagacaacgctgaaaagccgcctggagctgaacaatggttgaataccaccagccaccagagcatgccgcgttgaagcgactgagacgtacagtgcatccagtgagtgccatgagccagtaagagctaaatgtgatgctaaggagagccagtactggaactatccagagccaataagagtagagaaatcctggtcctgagagccagagccccgaagagaggccatagccgccccacgagcacaaagggcagtcggaagttgatcttcatgatccaagattcgcatgtatgcagtcattcgtgcctcgaattgtggatgtagacttaattgaacctgttagtttatagaaagagaggatttaattagtgctctgaacctctggttaagatattctggaccatagagtcccacccaaacttcgtattcgtaactgtagatgtctgtgagggaagcaaattagatctgtaagtgtgtacaagtcgatttatgaagtccctttcgggattaaagtgctatctccatcactgatggaaaaaaattgatatgtgtgcacgggtagaagctggtaccaaaaacaattggtattccccaaaaacaattgcgaattctgtggatcgaacacaggacctccagattactctgactgaagaatgacttcagtctggcgctctcccaactgagctaaatccgccagattcttagttaaaaaaatacaatgtttaccagtatctgaaacaacaaaaaaaaaccatgaatctttagaataaaaaaaaaaaaccaaattacaccgtttacgatcttttatgggaacaaactaaaccaacctcgagtctggataagacatggaacgattgatatgatttcttgatctgttagccatgattcactaccacgagaccacgacaatgacatgaactagacgaagcgtcgacaaaccaactgacagcacctcgcagcgcacaccgcaatgattcagaagtgtatgatttattgaacgccaataacccggcttagtacaagtaggtatatagctgtaatgaatcattagtaaaaaaaacacaaccatacacctcgatactcctatttccactccccgatgccgcagcaattcaatcaagatacacacgaatcttcctaatgactcctatgctaataacgccttctacgatccttacgagaacaaactaaaccaacctcgagtctggataaaacatgagacgattgatatgattgattgttttactagtcctgactcactaccacgtgacggtgacaagaaaaagacaaaacgacaacgatattggcagtttcgaactaaataaacccgcaccgaaacctgcaccaaacccgcaccgaaatgattatcatgagtatgataaacaatgtttttaattaaaaaattaaaaattgcttatttcactattagctgcataatttaataatatgtgttgtcattctatacaataccaagctgctttttaatgctcgtctttcacatgatggagtttcgagcgttcgaactttgtattacgtaagggaatagatcatcattgttggtaacgaatgaatgaagagcatgcaaaatagtctctgcgggctgatgacattctacactcttagtgtactttgcctagctaccattgtcgttacaactgtacgacttctttctatcaagctacggtatatgtacttgtacattgttcatgtcattatcgttactctgtattgtgactactcgtatcgctgaacaatagcagcaccaataaccttagcatccttcagagtcaagctcttgtctctaagttccttattggggaatgtggtctggagaacgtattctcgaccagaggggttgtgttcatcaacaaaatcgtagagggactggacagtgagatcgggggagaaggagggagtaagacgagttccgtcgccaagtcgaatctgaattcggcttcctcctgctccagatgaggagtttgaaggaccagatgaggtagcagcaggagtaggggcggagggtggcggagtggcggaggaggagggggtaggctccccaggaacaggagatccgagacgattaccagaacctccgtagacaggcttcttctccacgtatgcctcttcacttcggtccgtcacgttaatatcaacggcctggttatgttggacatccaggagagccagaggagctcgtccttggttgagggtctcaaggtaccgctggtttcgggggtcgtcgtatctgtacagaggaccatcctcgactgtgaaaccgttctgccagaaggtgattgatcgagagaccttggggagagaggtggggagagcagactccacgggtcggctttggacctcgtcggagcccagagtgaaccctgttccgtggaagcttcccacctgttcctcatcctctgactcatcgtcgttctcacctcgaggtcttgctgggttggcctcagctcgtcgaatgatatcattaaccagagggttgcctccctggttgcccggctggccaggtctgttggggttctggacagccagagccgacttttctcctccagtgaataggtcctgtcgcttgggaggcgcattgtctcgcgacagatctcccagagttctgacacccgccacgccccttctaggagcaggagcaggggcaggggcagaaggagcaggagtggtgctactgctggctccgctgacaggagttgacgacccggtaccgtctccgagtctgtatccagagggctgggggttgctgaggattccctgtggctcagaggcagcagcagcaggatcatctctgccagctaggccactgaggaagccctggattccggcggcaattccactgggggccagacccgaggggttggcgtatgcgtccgagtcctcctcgacgtcaatgtcctcggcatcgtcgttttcagcatcctcctcgttctcctcggggtcgtcgttagccgacaagaacagatcgacagcctgagccacgtcccagtcggtgtggagcaagcaatcctgtgcatcttcgggcgaggactgtgtgattcccacgaattgcgcgattcgttcggttttttcttcttcagataccatttctagtcgttgtggcagcttttggttaagacttcctcaatggtggcaagttaagtgtaatgctggtccgagatacattaagcttttggatatgcaagatgatggtacacccgaaatcgaacgtcgatatggaggtgaagagatggtgcgttttacaggggacatctttgcctcgtttgaacggaggttgcttggtgctttcagtcgctttggtagctcccgagacttttgcataccttttggggccacgatttttggtccggcgccaacctgccccaaaatgcaagttggtcccgtgcaacctatggaggaaactactcgaaaagtctgagtgtactgtaccgggaagggctacgaaggtattccattacaaggagaccatttctgccagattgggggtatatatcacattgagcaagggttaacaacctttaccgtgtgtagtcacgtgaaggtttgtgttgctgtgcatgtagcaagtacagtacatactgtgtgagtaggtggcggctacaagtgcatactgtagctcttgatatgtgcaacccaaaaacagtaaattgatgcacatttgtttgaataaccgcagaatattggaaataatcggaaataataggtaaaaaaatataaaccgctagtgcgacatatttgggggggaagaggatatggtgtggacctatttgtctgtccccgcggcatacagtggtttttttgctctagacagtgccaatttaaccccagatcactcggtctttcttcgttgccctatacacacccaaacatgatgttataatagtcaccacgcagacaacaatatcgtgcacatgttttcttccgcaagatgacacaacaaagatgcaacttccaggtcaatatatataggtcgcctactcgtacgtgatgttatatatacaccatcgaccagacgcgtgcctcccaagttaagattacgtcatttcatttctaccccaggaactatgcacccagcgatatcggcagctccacggagaagtctttttcagcggaccccagaacatgtgtccaaagcgacgtgatagagacacaaaacaaaaactactagttgctaacatgacgacgactaaaaacatgttatccacatgcacttgatatctgcaccggtctataacgattacaggtattgtggacgctgtgtgtaccaaccgaataaagttgcatgaatgggttggtctattcacatgggtcagagtcacgtgaaggcgcgtaatatggggcatggaagggtcaaataccactctacccaatgaacaaagcacacggacggtgtctccgcttttatcatccgtccatacgcccggctggcttacatttgcgtgttcttgattggctggataatgtgcagttgtgcacgaaccttatcagtatgagtcaccgtgatatttcagatcacgaagtttcaccctttttgacacaaaccaactaaaagattttccccacacaaccgaaaaatgctgagaagtgctcgattttgccaggcacgattctcggccatcaaggctcgtggtcttgccaccaccgccaacgcctccggcctcagcgtgcccgctgacttcaagacccgaacccctccctacgcggagctcatcaaccgtcttgatcaggtcaagaagattatcaaccgaaatgatttgaccttggctgaaaaaattctgtattcacatcttcacaaccctgaggagactcccagcatcactcgaggtgacacttacctcaagctcaaccccgaccgagtggccatgcaggatgcctctgctcagatggctctgttgcagtttatgacctgtggtcttccttccaccgccgtgcctgcgtccattcactgtgaccatctgattgttggccgagacggtgccgatgatgatctgacccgatctatcgctaccaaccaggaggtgttcgacttcctgcagcaatgtgccgagaagtacggcatccagttctggggccccggatccggtatcatccaccagattgtgctggagaacttctctgttcccggtctcatgatgctcggaaccgactctcacactcccaacgctggtggtctcggtgccattgccatcggtgttggaggagccgacgctgtcgacgctttgaccggaactccctgggaactgaaggcccccaagattctcggagtcaagctgactggaaagctgtccggctgggcttctcccaaggatgttattacccatctggctggcaagctgactgtgcgaggaggaaccggaaacatcatcgagtaccacggcgagggtgttgactccctgtcctgcaccggtatggccacaatttgcaacatgggtgccgaggtcggtgctaccacctctacgttcccctttacggagtccatgcgacgatacttggaggccaccggacgagctcccattgccgcagcagcagctgctgctcgagaccgaggcttcttggctgctgacgagggtgctcagtatgacgaggttgtagaggtcaacctgtccgagctcgagccctgtatcaacggtcccttcactcccgatctggccacccccctctccaagtactccaccaaggtcacctctgagaagtggcccgataccgtgtctgccggtctcattggatcatgcaccaactcctcctacgaggacatgacccgagtcgcctctctggttgagcaggcccgagacaacggtctcgaggccaagattcccttcttcatcacccccggatccgagcagattcgagccaccatcaagaaggacggtctgacagacgtgttcgagtctgctggtgcggtggttctggccaacgcctgtggaccctgtatcggtcagtgggatcgaactgacgagaccaagcccggcgagttcaactccatcttcacctctttcaaccgaaacttccgagcccgaaacgatggtaaccccgaaaccatgaacttcctgacctctcccgagattgtcaccgctatgatctactctggagacgctcacttcaaccccatgaccgactccatcaccaccaaggacggcaaggaattcaagttccagccccctaagggtaccgagctgcccgaggagtttgccaagggccgacccgagttctaccccgaggctgccccccagccccatcccgaggtgaacgtgactgtctcccccgattccgagcgactgcagctccttgagccttttgagccctttaacaaccaggagctcaagctctcggtactcatgaaggttgagggcaagtgcaccaccgaccacatttcggccgctggtgcctggctcaagtacaagggccatcttgagaacatttcctacaacaccctgattggtgctcttaacaaggagacccagaaggtcaaccacactattgatgccgctgacggctccgagcagtctatccccgacctcatgatcaagtggaaggagcagggcaagccctggattgttgttgctgagcacaactacggagagggttccgcccgagagcatgctgctctgtctccccgattcctcggtggacaggccatcctagtcaagtctttcgctcgaattcacgagaccaacctcaagaagcagggtatgcttcctctgacctttgagaacgaggccgactacgacaagatccaggcctgcgacactctggagaccctggacctcctggacatgcttgagaagggtggtgacaacggtggctttgtccagatgcgagctaccaagtctgacggctctacctacgacttccgagcccgacacaccatgtctgccgaccaggttgatttcttcaaggctggttctgccatcaacttcattggagcccagaaggctgccaacaagtaaagccagtagtctccttagagcaagagaggctgcaccttcaaaaataacaacccccccaaaactgtaaaaatgaattaaagtcgaaaatgagttccgagatgagtaaaagcccaacgcacagtgcaaataatattccactgtaccccgtataagaccaatcaatattatcttttgaggccccccctccgctccaaacattcttcgggtctcatttgctttgaaaacccatgtgtgcctcaatgtggcaattccaggaagggaaaggggtcaagtcaaggggcaatcgtgaagtgtcgcaactgttgtgcagaaggacgggaactgatgtcgtcagttaaacaacagctgttgatttcgaaacatacttctttcgaggctgccgcacgcttgctgaggctcttgtcgtatagtcatgtgtgcctgtgtgatgatgcctcgaagcaggccgggttgtgtggcagtcgggggtatacgagtacgatacacaacagagagcggtctttgtgtataaaaagtcgtatttaagactcctgtgggggggggaattgtacacgcgttcacgccggaaagatattattattgctgtttgctcctgtttataaaggcagaaacacgcgccagcctgaacaccaaaaggagataccgaaacaaagaaaactgtgggacgataattagttatggaatggagaccccgcactactaatatgcgctatattctctttccaatccggggtccccgagactcgtaactgtacgcctttgttaatcagcctggtagacctgtcaacctcctcatgttgtcctgtcattcaattggtattcacaaaccaacatcacagaatgctgatctgcaagtgcattcgaaaattgtgatttcgattgacaccaatggatggttttcaactttggcactcattgaattgccattgttggtccgtgacctggaccagagctcaacgaaatcattttgtgcagtcagatgacacaacaatatgagagcacagattgagatgcatgcttccaggaacgtacaaacggacccccaagtcgtgagatactttgttacgtgtaccaataagttggagtattcgctaaagacgaaaaacgctctgatttggttacggcactggtcacctgcattcctaaaattaatcgcacatctggtattgtcttacagcatgtccacctctcctcctctccttgggtacagtactgtacagaagaatgcagcctttcatacataaatcccaagtaattttaagagtgatttgggtaactgtcccattacgtcatgggctcaactctccccgagccattgtggatcgtcacaggatttaattatatgtcctgtcctaaactctattcatcactgccgtacatggattctgcaatgttggatatccatctcaactgtacgtaattgtatgtcgtatgacctgtggacagcaaaaaaccccacaaaccgaccacaacaataaaaccagtcctttgactccccacactcgacgtgttgatgagatcggctgccttcacagttcccagttttgcatcagcacgcacattcaatgctgtaattacgtattggtacaggttccacgcgtcatttatcacgtgtggggacacgggaagataacatagagcatattgcagcctaccaaacgaaaagtgaacctaaaggatatcaatacagacactcccgggcaaaccacagttgagaatcggcggttcggcacacctcggaaagaaatgaacacgtggagaaaaccacagcgtcgcctcgtgcgtagtcgtacctacagacagccttatctaagcctggggcataatatggtaaggagagacaaactgcagctcttccagcggggtgcagtatacgtacttggactgtactctttcagatactcaatgttgcgtgactacctctgcacatttcatgcatctgaatattgagtttgagtttgattatagttgtactccacatctgatatatcaggtcgttcgtcctgttcagcgaggcgtgcaggagggtggcaaaaatgtaccgacatatcaccagctacccgcggcggaatttcactctggaaagacatcaaatttatgagtaggggtgttcggagagtaatattgtagatacgcaaggtacacgccgttaagctaaaacgtcgtatatgtcatcaccttaactttgcagttgcagttgcattaagggctctccttgtcctgtaaccataggcgcggcgttactattattaagccctgtggtataccggttttatccatgtgtgcttgccacccggtatcttgacagtcaaagttcacctagctggccctcaataaggctgtacctcatacggtgctcaccagttattttcactttggagcagtcagatccccagacttcccctgggctggttggctggggtaaacgtgtgagttgatattgcgccaccatactccttttgtcggccaattgaatcgggaaaacagggaggtcggtagagagcgaagataagccggccagggctccctcgtgaccacgttctcacaggccaataaagtacctttagccgaactggcgagtatgcggttggagactaatacagctttacaactgcattacaacagtccaaagttaggcttttggtaatacgcacaagggactatagaacggctggcatgctttgttgagttaagcccatacaccggcggttgtctgaggcagggcccaatcacccgttatctatataagctgggtctggtcccccacacctccagcctcttaccaacaatcttaaccatctgacacacaagaaaacacaaacacgcgctactcatctacagcaccgacagctcaagtctcgctttcttgtcgacaacatacaccggaccgccgctaagccgctgtagtcaaccacaatgagcgaaccctcccccaactccccattcatgtgcaataccagcggctccatctacactggtatggccctacgaaaagtcccgactaattcttaccacaacaccactacggaccaagcccagtccacaacattctcagtaccacctggagagctcaagggtcccatgtggggcctctcgtgctacgatgatgtccaaggcctctacacatacaaggagattgacccgttgaacattccgcttcctccttcagcgtcagtcaatattcaccacacccaatactcttgcggaccttacgctggctcctgtttcacccaggggtataaccacgacgtctactctgaacagacctattcaatgtcttcggatttgtctcaagggctgcttctatccagctctcaggagtcgcatgacggcaccatttacagttacgagactccctctaggaccaaccacgcgcaccactcgcacagctcttcattttctgacatgggtcagccagcctcttatcacgaggagttgcacgcctcctcttacgactcgcaacagtcgtgtttctccgacgagtcgcggttgtcttccttctccgaaaccccacggactccattttcaattcaggagttgccatgcgccatggagaagttctcaacctacttccatgaatcccccaaacccgcggatatggatatcctctcacctgaaggatcggactctgaccagggttccagtgaagcttgtggaaccgccgtccaacaacttgagagagtctcctcccttctgtcttcaactcctacgggacacttctcgaacgttgacccacgggtgagagcaacatcattgttcaacacccacgttccaaagagggtctcaattgagaattgcgaagaaataaaggccctaaagatcaaacgccccctcaagaagcccaaggttctgaaggagtttccctctgtggcagactttgtgtatgaccccaatcatgagtatgatcccttcgtgcagcccacctcggctgctatggcgatgctcatgagttgcttgaagccaaccaagaaggatcaggttatgattctgaaggaaaataagcgccaattctggcagccaaactccaaataccgatgccactcatacgtggaccggattctggctagtgagacactcattgccatgctcttcaagtctaagaagggcccaattgcctgcaaccactgctccctcaagtttgagaattacttggcgattgctgcccatttcgatcagtacaacgtcacacgtcctggacggtgtaagtatgacgattgcctctcctctgtccttgggtttgcttcgccttctgagcagagccggcacacaaagactcagcatggaaacactgcttacacatgcagtgctgagggttgcgcttaccacagtcctcgacttgactgtgtgaagcgtcactattgcaaaaaccatggggaagaggctgactccaaggtcctctcaaaaggagtgcgggctctcaaggatctgcccaacaagttccaggatgttaagaagtcaaaaacactgactgacgaagaggttcgtcagcaggtggctcctatcctggcgaagttgcgtgagctcctgtagttgggaagactactattttcagtagatggctatggggtgctgtctcaatagacgccaaggaagataggatatggggatggaaaagatgatggaggtacagtagagggtttttatttatataagttataatcaatcagtgttttatttccactgtcgattagtacgtccgtagttgttatgctgtagtgtttcacaatcacgtaattaggtcgagagccgcggaaactcagcttatggcaggaaggtcttgtcgagcgcctgttttagtaaaagcacctttgaggtgcagaatctgtggtagttttacacgaaaatgccggtatcgtatcgtacatactgtaaagtgtaccatacgcgtggtgtatctcaaaaaagagaccgttactttgcgacgtcactgccccattacagcccaccaggggttcaggacacacttttaaaagtgcaggggcgtactgtagccgctaccaatttgaagcaggaatatgtatgtacataacattgagcatcagtccgttttgggattcagtttccgtcactgatgctctttacggtcggcctgtagaggctgataatgatttttggatccatctgcaggttgcagttccacttgtaatcgtccctttttttggctaattaacacatctaatcttaggcaaccagtttgtgaatgtcggtcgtctatttcccctttacttggcgccgacgatcagtgaaaaatctccctgtagatgatagtcgcctgtgaaaattatccccaacacttccctctgatcattccaaatacggaaaacaggcattatcaccaacctactcgggcaacccaaaactttttttcgccggggaaaaagacgcaagtgccattcgtgagtgggtgaatagcagcgttaaccggtttagagtgcaacggtacgagcaaaagacttccgcgagctaggccccaccgctttttttcggctgtaagctgtaagggccagttgctgcgtaaagtccgatacagtggactttgtcataaccgacatctattaccacaacggccttacaaccagtaatgtgacacttccgcatcatcatgacaagttccactacgacccaatatgaagatcttaaatgggccccagtcgatcgccaaaagagctagatttcgctaaccacgacgttttcaggtgtctggcttcgttccccccttgactcttgctctcttggaagacagatccgatctactgcttaaatctcgcgccactgcggcgttatagagctaacttgtactgtgccggggttaagcacaagactgtgagtccggttggccggaccagcttgtgttgtaaatgtctcattgtcccaaggttgaatagacgaccactacgtacttgtggcactatcgcacttttgccgtcttggacctgctttattcaagggcttgtgttattatttacaagtacctaatcggtggcaaatcctgcccgaaatcccatctaacggttttgggacctctatcaagtaaaggtgagatgattttagtgtgcccacggaaggttacctacttgtcgataatataggacccatgtgactatagatatatgcactagtgaacatgaaaataactcacactcgactgtgtatcccgatcatgactcgcttatcaagaccttgcctacgaccggcaagtgccgtaggtgaggagccccccccattcatcttttttttttttgtctcgtttgtctctcataattatttgcaccaatgttaatcagattgccttctttgtctttggtgcagctcacatgtattaacaaacttgcgggatagcgtaatgacagtaagaccgacctgaggtttaaaatcacggactcccatacatagaaaaccaaagagaaaagaaagactacttacctaaaacaatactcgctactcgctactcgctcagcaccacccaccgcccggcagtccataaacagacacaagacagtccaactagactcctctcctttttaaacctgtcacgaatcggtcgacttgcaccacacgacatccatcccaggcacagacagacacagacagacaaggccataagtgtgacacaaactgtcatcagacacaatgccggcaagcccgaaaacgtctcaaagaaaacaagtgggctctggacccgcgagcccgctcagtcctagcgcaagcccacgaccaagtcctttacttactagcccggggtcattcctcaaacgagcagttagtgcggggtggaaacgacggcaagaccctctcgagcatccactgccaccgggatcggtgtcatcgtccgacattgacacaagcccgacatctccacgtagtcccaacgcggtaggtcgaaggtcttcacgtggcggactgagcagcagccgactgagcagtccagcgacgagtccgctcagcagtccatactcgaccagctttgccagaagcgccagtagttcgtcctttctccctaacgcctcggagcctgacttcgagatggtcactcaaaccagccaccagcaccgtccttcccctcgagttccttccaggagttcgcccggtttcaccggatcgccaaagatgcaccagtctgagtcttcaacttcaatactctcattcccgcctgaagtcatgactgtgaaaccaataggaccgaccaatcctacccatgtgcgacaggagcagccgcccatcgccagcgacgcttcctccccttctgtgcccgttatggcgcctaaaagacgagagtccttacgacgacgatcctcattgaacaaggggctaggaatcgacagcttgcccgccaccagtccgttaactccccgacggcagccgtctctcgcgggctcttcacgatatgcgacacctgagcccgaggaaccgcctttgtctcgtaccgacagcaactcgtctataaccgaggagatcatgacagtatcgccagtgtcaccagttctacagacgcctcctctcagcattacccccaaacgacagccgtcagttgatggctcccttaaccgggctaacagtgtcgctgccagcctgagcagcagagagggatcactcgaaccctcgtccccagtggtgccacctagaggtggtggtattcgacggcattcaagtctcaaagactttggtgagtatggaagaagaggaagaagaggaaggagtggaaggacgacggaatagtctgctgtgaggacacgaatattgcatagatcatgtggaactgtcatgcgtgcgtgtatcaagatatgtatggtcacccatcaacatcagcctgatgcttagtcatatgtgtcttaggcgcccagacctctctcggcctctgtggcacgcatgcattacaggcccaattgggctgcatgtacaactcgtacatgattttggttatgctgttgaaggcccgtaaagttctgacggatattttaatgataagtgcgagatacgcatgaaaaattattacgtccaattcttaccaacaagaaccaagaaccaatctggttttagttcttgatgtttggggtgaaaatgggcatctttttcgggggctaaagaccaactggtctcatggttccaatgaaggtgcctgtcaggccgacactacttcacggatttccacaagcagccagagggcccgctgtgcagcagccacactaattgtgctgtagcgctgtcaagcagggtgagtggcagacagcccgcagctgcatgagttgacattattcgtgtcccaactattgacacaattcttttttgcatgggtgggaaggccatgtgatggtgagggcatgctacacgtacaacgtgaaggatgattaccgcagatacggttttatggtcgtttcatgtggcagctactgtgcctcatccttccaagtctcttgagagtccacaccttgtccgttggatctccccgcacagtgaaacaagaggatttagaagagagggaaagacacactaaggacactggtagtctttttttcacatctgtgtgggaggctttgggttttggtcatgcgtctaaatggggacagagaacaaaagcgacgaaattagactacagacctaaaaagccagtggtccctcctcagctatgactagggtgtccttgtctgtggttaaaaaataagagctgctgcatatcctctgccacccacgcaacctccgtcgttccattgtggctgcccgcctgccgatttcacttctcaactaaccacttttttgtgtttgcggtctgtgattcagcccgtaaacgtttatcttttcttctgtgcagacaaatcgccgctccacacacccaacgtttttacctctgaaacatccccgctatcgataaaccgacagtccaatttgcgaaggtcggcctcagcgtattcacaaaaatccgtcaccagcaacgaccaaggctactttgctcctagaggcgacattccctccaagcctggaactccaacctctcccggaacccctctgaactacagccaagagatgatgtcgaagagaacgccagtctcgactcagacacaaaggtacgactcacttatccccccagtagatgcggtttccacgacatcaccggtgacttcaccggctacacccaatcatgacgctatggatggttggtctcctatgaaaacacagccagacgtgtccatttcacgagcttcctctcaacaatccatcacagcttcgactgctcgaaccgctcatccccctctgtccgtggcttctcagcgaatctccaagaggataccgggtcctcccatgtcatcaatgtggctggacgacgacagtgacgaggagactaagcctgtgtcaagatggaagggcctgcggcgttcctccaagacgaactctaccatttcgatgaacctgccaggtaattcgagtgcacacggtatctctcattctgcatctttccctttgttgccactgcgcgagtccaccaaatcggactctctgcggtcgtcgtcgtcgtctaactacaacgagtcccattcgcaccgaaacagtgatcgacagtcgagtagcgacaagagcattggagccgatactgaacactcttctgtgtcttctcctgtgccatcagtgggagcttcatacacccccaaagcatcatacatccccaagcagacctcatacaccccaaagtcaggcacagaatcaccgtctcgactcaagtcacctcttcgacgctcggagagtggctccaagtggagtgtcaacagcatctttactcggtctccccgtcacaagaagtcttcgtctatctcttctaactcggatctcaccatctccatctctcgtccttacaacttttcgcatgtggagcacgcggacgccaattcagaagcaatcactatgcctgctcctgttcctggttctcccagttcacatcttccacagcagtcccctcttcaacgaaacaagtcgacttcgtctgcacataacgctctgaagaacggcctgcggtcagtcaaggacagagctcttggccacagcccatccaagagtctgtcgggtgaatcctttgacaattcctttggtggacctatttctaagactccctctaacgccactggctactctgtgcacaccactcatagccgaacgatgcttgcagagcctggaatcaccctcaacacctcgaagccagtgcggcctcgccgccctgacgatattgtgcttccccggggtctgagtaacaatgaggaagagagcaacgccggagctccacatggacaagctcgacgactatccaactcatcgtccaactactccagcaactccactgtgggcagtacagccaagtctcaagttggtgtcactgctgccaccactcccagcatgtctccagatggccgtgaagctcgattttcttctgtccagagtgaacatgcggcgcgggttgccaacctcttgaaggacaacggcaatctcagcagagcctctcctgccaactctcctaatcccaatctcaatgctttcccagcacccaatttgtctgtcaaccaccgacagtcgtggcgcttctccgatgctgatttggacattgaggaggaggaagagatggacggcgagtcagagatcaccacgtctccctatgcatcaccccgaatccctcagcggtctgaacgacgacgtggatccacttcatacgatatcaatggcttcatccagactcctggagttgccccccagaccttgttcaattctccaagattgtcccaacagtttgagtcctctccccagacattgcaaactcctcaaacaccctcttcttcgtcgtcttcaaatgcaggcttccgcagaaagaaccatggccttggactcatcaagaaccagccctcttctgattcgattggatcatcatggacatctccgggctcagactttgtcgagcagcacaactggttgtgccagactgccccacagtcggatcttgagagtgctgcctccacacccaatgcgtcacagactaccttccgaaggtctgccttgttgccctctcctctattatctcaacagcaacagcagcagcagcagcagcaacagcaacaacacggccagcagcagcagacccaacagcaacagccttacatgactaatggcagacacctttctacttcatcgctaccttctcacggagcgattttggaggatcttgctgaggaaaaccctgcacaccgaccttccgtgccatatgaacagactcaaacttggatttaggtgatgtacgatacaacaatgcattttaattatcacgtctttcctggacaatttatccacttgtaccagtatgtacagcacaagtagttacactttgtacggtagcactatagaccttccttagtctactgtagttacatgtgctggtaccggtagctactgtgactgcagcaaaaggtctacagtgctaccgtacctcatgtcagacagctacttgtactgtacagtttcgcacctacggtagtgtacatactgtatcggtactagtagatcagaaatgtatcaaacaaatgtatgggtttacattacctgtaggcactcagttgcaaccgaaatacgacactcgtttccctgacccccctgacatttcccttccttgtattattctccagtaacagtaaaaccgaggctagagaatgttttatgactactgtatgtacgatacacctccgaggtcaaattatgggccgataagcacactacgggtatgggtacgagacaccacaaacaagtactcaagtaaacaaatgtatggggattggtgtcattataaagaggaagaccttgtcctgtcaaatggtgagtagttgctgatattttcggtggcgtatgttggtgtagtctacatcacagaatgatggacaatatggttgccagctgttcatacaacattgcacaagggttagcgcggaatattatatgaatacatgcgggccgcacagtttggtgggaatacctacctacagtactgtagacaccagagagtggggcttttattatgccctcccatagtcaagtctatcgatgttggtttcaaatagcgaggtcagttgaaccatgtcgtaatctactgaaagtggtagtccagccaataagattggacacgtgctaaacatattggaccgagacattcgaccctagacttttccaattgtggtattacggaagtctttttgaacttcggtctcatttccgcctcctcgtttcgtttattgcgactagcatccacatgcatgatacctccggttgagatggatgcatacagcacacatctcccagaaagccaaattattaatctcactttggagtatcagaaacacgcgacgaagacacataacatggcggaccgactgacccagctacagacgtgcgtggatcaaatgctgacccagtatttctcggcactaacgcacattaacaccaatcatgggttcaagtcgttagcgggggaggagttggtcaaggacgatacggtgcctgttgtcacagacgaagaacgcgagagaacgctagaggagctggcgaaagaccttgtggtcaagtcacaacagattgattacctcatagattcgttgccaggtatcggttcttcggaggaacatcagatgcagcagatcgaaaagctgcaaaaggagctggagcattatgatcaggtaacagaagacgtcatcaaggagaaggacgagttgttggagcactgtgatgaactgattctaaagctcgcacagagaaaggcccacatcgacgtggagagcatgtaaggatgggcaaacacccgataagcctgccctgcgaaacgggcagcagaaaaagaggcacgacgggtaagactaggcctgctcacatcctaccgcgaggcgttcttatcactggtaataccagaagcctctagcatcttgtggagctggagcactctgttctaatggccacatctttatagagtgcatcaatttttgtattgtatgtattataaataatcaagaggctgcgacagcggcaacctcagtttttgtggcggtggcggtagtcacgtccccagttgtaggatctttctcttcatccttttcggtaggcttgatcttgttctccaaagcttccagtctacttttgacatttgcaagttcaaccattttatcaacagcactctggaagtggccctgtgctatacgaagcgtgtatggtggcatgataccaaacatcctgatgggatctgttttcgctcccttctcctccttcttgctgtgtatcgtgaatttctcactggcatgtgacaccgtgatctgggcgcattggggccgctcatcatagctaaacctcgatattcgagaattaaaggtcgaagcggccatgaaattgtcgtagttggtctttgcaacgtccaagtggccctgcttgagctcttcgcacatgtccctggtcagatgttcatagtcatccaccaactggagcaaagtcacaaacagatcgtcgttgccagagcttccatcatcgtcctcacgggccagattatcaatctccagcttgctgaggccctccaacaggctggccaggttcggagtaccggtttcgtcgtcagtagtcataatggtggtggagttaatgtacagtatgtacatacatgtacgttgagtttcgtgctatatgcgtcttgcactcatagcaacgacgagaaaaatataataatctccaccagctcttctacaagcaagtacaacaagtacgggctccaaaaattctatactttattatctttctcttattatactaaacttttatatactgtttactcgccctttcggaactccaccttgccctgctcagccatcttggcgacctcctcggggtcaagaacattgccctcctcatccttgtaaaccaccttctggttagggggagcggcatgaggagaaatgtgagcctcagaggccttcacagcctcagcggcatcctcaacggcctcggcgatagagtggtcgaggacagagtcaacaaccttctcatcaacgggcagaatggaagcctcgttgtaaaggtcaagggactcgtggaaagagttacagtcgaaatcccagccaggaagccacttgcccttctcacacagagacttggtccatgggtctccgtaaatgatgggagagtagtagacgtagaaagagagggcggcagcaaagacaccaacactgagagcacctccaataatcttgtttcgcacaattcggagggtgaagtactcccaagagcagacaaaaccaaggaaaacaaagtagagagagcacaggtagtggtgcaggaagagctgtcgagccatgaggtaagaggggaagtagtgcagagcccatccaagaaggaaggaggtgaactggacgtcgtaagctcgcagatcaggtcggcctgcaaagtcgttgtatccgcgctggaatcgcagcagattgatggccttccacaagaggaagataccaatagagagggtagtcaaccaccagatgggagcgttaccgagaaggtagacctgtcggttatccttaacccagaagttgatacctcgttggaggaagggccaggactcaggtcgagactcccaggtatggggatcagtaagtcccttgttgacagtccacatgaccttgttcagctcgaggaacttggacaggaaagagggggttcggtaagaggctcggtcagtggaatccacgagagtggggtgggagttagactcaatgtaccagatggagttgggaagagttccagacttggcgcaagttacctcctgctgctcaaaggcccacttggggagcttgacagagtgagagaacaaagcacaaccagtgatggtgtggataagtctgaacttggtgtcgatggttcgaacacggtcccgagagacacccttctgggacttggacttgacaatctcgactcggaagttatcattggcatcaccatcgaaaccggggtaaccgtaggcggaaacctcgttctggtagtcagcctcagacacggggggtcggaaatcgtgagagtggattcgtcggccagtagcaatgtgcttgagtcgaatgacatcaccgtccttaaggaagatctggtcaccctggaagtcaccctcagtcacagtgtagttttcaactaggaaatcgttgttctggtcagagtgagggtagagagtgacctgctgctgcttggagccagtctcgtagagggactcgtgagagtgcaggtaaccgccctgcgtgttgaggtgtcgcaaggtgatcttagatccgagaagaacatcagcgggctggtttccaataagagtggagtgctgcagggtgttttggaactcgggggacatgaaagaagctccatcaccagtgttgacaaggcacaggaagtgcacggcaaacattgcaacgtagaaggaaatggggacaccaatgaggaaggcagctctccagccgaagtgtcgagtaaaggagcagggggtgacactgagatcaccaagggtccaccacaggtgccacagagtcatgagacccatccaggcgatggtgaaaagaccgtaccacttaacagaggtggtagcaccgagagccagtccagacaggaacaagtatcggtaccaggcgccggtgaagggggtctcgagctcaaacttcttgaagaagtacacggtgagagccaggaagaagataaggggcgaatcaagcagaatgtaccgcgattcagtgacaagagagttctcaatggcaagcagagcagcaccaaagaagcaagtggcggttctgcagccggaagccttgagggtcaggtatgcgagggccacggttgcgacaccgagaacagcagggtaggatcgcatggcaacatagggaacgttggaggacaggtagtcaacaccaatggaggagaattcaaactcgccgtcatagccagccagccagccgacagcagcgaagagcatcttagcaagaggagggtggacatccatgaagaaccgtccaatgacgtattttcgggcaaaaccaccaaagtggacttcgtcgaagaccacactggagggctgccagatgtttcggaatctggtgtaaccggcaaggaaagagaccacgaagatgagcactcgatccttgggtgtcagagcgcgttcctcagacaggttcttgtatccgggggccggagtgacctcaggagccatctcctcgagggccgatttggcgtacacggcttgtaccgtcttcttttcacctttggacattgtcgcgagaagtgtcgtagtagacgtgtgaagatgggttcgttagctacgtgtgtgcttaaaggacactctgtgaaacttacgtggcatagagtttcagaagtgaagcgaggagcagtgagcctgagacgcgacatggtcagagcctacaagtagacaaagacgcttgttcgccggcttgaactgtcgcctaagcagaatttttcaaaaatcaattggaccgatctttttctactctgtagtcttcttctgatcccaataagcacttgtttggccactgaacctatgctgtgatggtttgcactaactggtttggtcctgcacgctgcactgtcaggaacccaattgttggcctctctccacactgccaaatttcaatgcgaaactcggtttcgtgtcgtgaaaattgaaacagccagggggagaaagatatgctgagggcaaccgaaacaccacagagcacacacgcctgcgatattgcaagcaaaatggccctctcaatgaaaggatgcgtggatatcaaaatccacgacactaggggaagaaacagcccctcactgagccccacctgatgcctgcccttcaaaacgccaaaccagacatggtcaccatcagatgagcttaatttgggtgtgctgccgaaagcgtgttgaattgactcaatcaagaaagtggattacaatacggtatcgtaccggcggtactggtacgggtacgacacacacaactatggcgcatccataggttggaattgcatacagtacgagtacgagtatgtactgtaccccagtatagtcgcaacagtagtagcataaggacttcattgtactgtacactcgtacggagacgttaaaggtgatgatactcgcaccgagcaagtcgaggtggttgaaccttcaatgaaattatatggagacagaagatgtctaataatactacagtacaggtacgtacatagtatggccaggtctgtgttgattatagcagggtcaagagctttgtgacgtggcatatttcttgtttccttccttctaatttcatgaagcaacacgtcaaccagaagtgattatacttttttttctctcacgcaggccatccaacatcgaagcattaaatgatgatgagagtcagggtcgatgcagcgccaagcaaaaaaaaaacaaaaaacaaaccagcagcaaacttcttgtacctgtgattgtagacttcttgttacctgtgatggcaggttacttgcacgagtatgtactgcactgtaagtggacaaacaacgcccacataatgtcaccagtgaatagcctacctcttataaattatcaatgttagtttatatacaaaatgcaaaatgaatgatgtcttgtggcttcatgcagcacgggttctggctgtgatgaaagaggtgacgattacaaaagtcacaagtattggaaagttccttgatgtcagttgatgagacatggggtttagatgatccacatgcctccaccatttgcgtctgtgtcgtccagaatactggccagctcagaaacagcctcatccttagcatcccagctcatcttggaggagactctgaccactctcaatttgggaatcttgtcttccaaaatggccagagtaatgtcatctgctctcagtttatgagcctgtcctaaaccgccactcgagtcgatgtccagaatctccagaggatggctttggaaatggccatcggcccttttgaacatgccgtcatcaaatatgtgctttgtgagatagtctaccgacaccgaaagatgtcgaaggttgggacagtgtcgcaaaacttgatccagcgcatctggtcgcaggccgggcatggggtaaacaacctcaagatatttcaggttcgggccgagatattggcacaaaaagtgaaatgagttgacagtgatgaaggggcaatgtcgcaacgacaaatgtgtgatggtatcagcgaatcgggtttctcggatgaagtcgtctgagattcctccagaaagtcctagtctccaaagttttgggggccagacattatcgtactgctcgcagaataaagacgatcgaggaaaaaagagttgttcgagctcaggagattgtcgaagtgctagaaacaacagccgcagatcaacaacctcgctgaccagagacaagtcaaggcagcgcagctgtttgcagtgacgcaaggaaaccataggagcatatccaaaggctgtctgaggtgccacaaatagttccaagtttgctgaacatcgttttaacacctttgcggtgtaagagttttttcccgactgaataatggagtccagccgtagctctctcacatacgtgccaaagtaatcgtttgaagaaacggcctcaacgaacaacttgaaattgagtggacctagttccggagatttgtataggaacggtaaaccacatcggtaccaagtcttacacactagcaataggtcaagagtgatgggatcctccaatagtgtgaaaatcgtgtcgacgatttctggggggaggaacacagagtcagcagtagccactaacgtttcctgcgactttgcgtcctccccgatttcatctatctcgtttgtaggtcgaataatgagcgcatcgagggcggccgctagagtgtcgattttctcaaactcactgtcgtggaggggctgagcaatcgttttctccgcggtgccaactaccctcctgtagggaggacggttcttcttgggtcggtgtttgttagctattgttgcaagcccggtggcaaaaagatgatacacaggaagggtttacatgctagatgtggtgttgcaatatagcatctcaaagtgcatgcaagccccgcagcctctagcttcaagattcatgcaggtgagtctgggcttgccagttcgagtctttcaaatgtaattatatgcccaacattagagataagagatctggcactagataaatcgatcagacgaccgtgtctggcgcgaaagctgtacttttacgagggtgtcacaccttgaaaacaaagggaattgaccaaataactccaactacggactatggagactggtttgtccactttagagggggcgaattcagagtttaaagggcgctaacaaacgaggcgtggggaatcgtttgaccaatatatacaagcgggtgtgagcgggttcttgttcgagagggtctttctaaggataataactctcatctaggtccttctgtgtcttgtgtgataggacctgcgaacctccatcgtgcgcacccgttgcggtcacgtgatgttacgcatgatgtagcaatggtggggaggattggcggctatacagttctgacgcagagtgagattgttccaggatattccgaggcagtcctatgcagcagttacttcaaccacatttcaaaaaataggttcgtgaaagtcagggccgtacaggtctcactctgggttggggttagggtctgaatcgggtaaatttcacgtaatagttagtgtgagaccaaagttacacacgtacaccactgactgaggcaactgcacgtacattgcagactaattgtagccgacgcgggaacaaacatggagattgatagtttggtaggtgtattttgaagctcaagggacatgaaatgccgtatattcttggatattagcctgcgaggatagcagcaccagcagcaaaaaataagctttcaacgtgggctaaggtttcgacaacacatcaccaccacgaaactgcacaccagccccttccacacacaataacaccccaacacatacacaaaatgtctaccaaggctcttattctcgttggaggcggtacccgaggaactcgattccgacctctgtctctggacactcctaaggttctcttccccgttggaggcaagcccatcctcagccatgcagtcgacgccgtggcttccctcaaggatgtcaaggaggttctcctcgttggtttttatgaggactctgtcttttcccagttcattgctgacaccaataagcagtaccccaacctcagcatcaagtaccttcgagagtacaaggctatgggcactgccggtggtctctaccacttccgagatgtcattctcaagggtaacccctcccgattcttcgtcatccatgctgatgtctgctgttctttccccctcaaggagattgaggagttctacgaggagaagaaggccaagtatgtcattcttggcaccactgtccctgctgctgtcgccaacaactttggtgccattgttaccgaccccgaaactcagcgagttatccattacgttgagaagcctgagtctcacatttccaacctgatcaatgctggtgtttaccttttcgaccagaccatcttcgacactatcgctgctgctaagaaggtgcgagaagagaaggcccaggatccctcttttgttggtgagggcgatgaggaccacctccgacttgagcaggatattctcgtccagctccctgctactgacgctttctacgcctacgagaccaaggacttctggcgacagatcaagaccgctggctctgctgtccccgccaacgcgctttacctgcagcaggcttttcaggctgatcccaagcagcccggtcttcaggctccctctgccaacattgtgcctcctgtctacattgatccctctgccaagatcgactctactgccaagctcggccccaacgtgtccatcggtccccgtgccgtgatcgccgctggtgctcgaatcaaggactctattgttctcgagggtgtcgaggtcaagcatgatgccgccgtgttccactctattcttggtcgaggatgcaagattggatcctgggccagaatcgagggatccgctgttgctcccaacgaccactccgagaccctcgttaaggatggcgccaagatccagtctgtgaccattctctcttctgacgttaatgtctccgaggaggtgcatgttcagaacactatcgttcttccccacaaggacatcaagaacgatgttgtgaacgaggtgattatgtaagagtcgacgattgatgtagtaataaataatgatgtaacttctcagcgagtttgtaaaaaactacaagaagcagttgccaaagatttttagggaatgtgattgtctcattgaggcgataactaacaccaaacgaggaacattgaatctgtacagaaaaacgttcattacatacccggaaccttatttcacacacctacagtacttggattggtatgagaatcatatgccagtgatttcaacaaacagttcaaaatagcgtcaaaagaaacaccaaaaaaaaaggcccaccctcgaaagactgcgagtgggtcacgtgtgcgcgcgtttaaacttacggattagaccgcccagctgttattgttagcccaagggtctcaccaacaaagggagctaacagccgcacaagacatttgattgttgtgtttcagctaaagaaacggctaaacaacaggttcagtatcggatcgtacgcatgaaacataatgtaaacaaaccaatgggcaacatcagaatcagccgagagctgttcactaagcgcacactatatcgtagaagaatgttggagtcactaagtcaaacctggttcatgggtgagaaccacgctccggcttatttggaatcctgtgatctgctctgctccaacatttacaagacagctctcgccgtagagtaaaccctactataccgaagctgcagccagtgcatgcctcagttacaatgaccatatatttcggccacgtgagggaggaggtgatgaggttaaaaaattctgcgcgacagaagaatttatacctctcaatcaatcacgtgaccaaacccaaccttaattgcttaaccccgtaggtcccagtcccaaattgttgtcgctgaaatttctggctcatgtggagaaggcgctgtaagaatcaaaggtggcaagtgatatactgttgtacatacttatacttgtttgtgtagtttcgagggagcctttttcaggtgctgaagtcatttgatcctacggagatatatcggtcctacactattagcaaccccacgttatgttgtggtaaattactacatgtttgatttgctgggtctgtactagtatatactcaacgataggtctcaatataatatgttagaatctttgaaatgaggactgtacttcattggaattgatagtttagtcccctacgccacttgttgatgttgtctggtaccgcggtcggttcggttatcgccacaagcacgtgacctcaaatagagttgtcccaacttacctgtagtgaaaaatccttgataattactcacaaccaaactacacgacacaaaaatggctgatcaaggaagagacccctgtcctattgttatcatcaacgatttcggcggtgcctttgctatgggtgtgagtatacggaatattcgaccgcaactgggggcgtaagcgtcattattccacaatgttccattactaacaacagattgtcggaggtactatctggcacggtatcaagggtttcagaaactctccccttggtgagcgacgagcaggtgccttctctgccattcgaatgcgagctcctgttgttggaggtaacttcggtacttggggtggtgttttctctaccatggattgtaccgtcaaggccattcgacgaaaggaggatcctttcaactctatcatcgctggtttcatgaccggtggtgctcttgccttccgaggtggctggagatacgctcgaaatggtgccatttcttgtggtctgctgcttgccgttatcgagggtgttggtattgccgtaggacgatactttgcggctgctcaggctcctcccatgcaggctcccatggctgcttaagtcggttgaaggaatggctacttgaagttttgcccggagttgatttccctgctccaggaggtgttcagtgggttctttcacacccacatatttatgacagaagatgattgtatatgtacatagcaatgaaaataaacgaattgtataatccgtgatatgtgaatctcttgactgtatttaacctgaattatcctgattgaatggctatccttatctttatatcattggatagagcacagtatccgtgagggcatggcatgtagctacactatacatctatcactgaaaatagtacagatacagtagtgatttaggagcacaacttttgtagcagagaagtaacaatgagaccacttctacaagtacatactgtagtggtgctcggagataatgtagtccttggcttaaatgtatacaagtattatcctcaggaatttgagcaatcggttagcaggttgttaacgcacaagaatcggtagcatgaatgataggtctcctgataccccatacatacttgcagatggttctggtcgaatgaagaatctacaagtgtactgtatgtacactgcttgtggatagcctacaagtaggtacgctggctcataacaccaccgtgactacatgaaaattcgtttacacctgcgggacgggtacttgcgtattaaggaaatttaccaacctccaaatcgatgttatcacttacaagaggagatcacaaacagatgacactgggtgcacacgtggatacgtctgtgatggagaaaaaagagcaaaggatcataaatgtttgcactttgacatttgtgtagtgcatacagattataggtacagcaccggggaagtctcatgccaagtccgaaaggagtaggacagcctggggctcatgcatgaggagtacagacaggatggccgaggttccccgatgtcggaattggaggaggtgtcgtggggggggggttcggctttcactagaattcccctacaagtaggagaaatataacagaccaagttaaaccaatataagtagataaatgcaataatctctctacgttgtacttgtacttactcttcgactttgctggacgcatgcaccactcactccgcgaaatatccgatgtctctagacgtgtgggtagctaaataacgcacaagccccaaccggccggcttcaaaccaggccacaagctatactacaatatttatactacacttgtacaagatcattacaatctttgcatctttcccatattcgcaggcccttgatttcttgaaatcacgtagtacaagttcaatgttgattaatctgataaaattcaggatgtgacgtcaaaacaagattaagcttccaaaggtttctcctaggtgttggtgtgatatgtcatccgctggagcaaagcatatcaattttacttggtctagttttatatgccattatcgaactgtcagtgagcaatgattcttattattctacgaacttcaacatgtacgggtgatcttggacattacaagtacatacggcaattatatgtgctagtacatacccgtacgagtacagtacaaatatgtacatcccataccagtacgagtaggtactcaccaacccgacatgggttccgagtcgcatgcatacaaatacatactgcaagacagttggttcccccaaccacatgcaagtccacaaagcgatccggactcctcattttagttttctggcaggcgtagctctgtggttcacctacagtacatacgacactggacaggtgaggcgatggggcccagacaatttagtaactaaagacctcaggacggcgtcatacagaaccaagaacatcgtagttagccagggataggaatggataatagcttggcaagaggaatgtgagagtcaatatacacgacattcatgcggcagacccagagttacaggtcctcggaccgtatttaagcgttagaaaaagtgactcttttgatcaacggcgctattatctgatggagatgcataaggttcggtgacgcaatttctttgtctacttacatctgataacttttcacattgttacagacacagcaagaagtgcgaattctgcatgaaatgtaaatgcgagtgtaagattctcgcagctacttttgcattggtatttatataagaagcagatccttcccacacgatcaccaacagaattacagcattttacacaaagacttccgacaatcgtgtttttttgatgttcaatggtggcgatacaagcaacagagaagtacagcagcatgagctgtatggactgccctgccttcggttactcccactgtcctgttgagccccaggatatcgaagatttgtgctgcaagcgagatcacgcaattaacttcggcaagcactacacagcgcgtaaagtggttccccacaaacccctaagcatcacacacggaataatcactccacccgaggaagccgacaacgagccagagtacttcaaaagacacgttttcatgtcctctaccctcgactccctaccatttgaaattagagaacagattgcatgggactgttcacaacgagatgctgtgaggctgtgctccactagcaccagcctgatgcactcaaccctcccacgactatacagtcatatcgtttttgataactctcccatccactactgtgaggaactctccgcagagggcaacggtctgctaagcaaggtcaccacaatcggaggcatgcgggagtgcctgcgaagcctcaaggaccccgacaaagcccatatggtgaaaaagctagaaatccggcgtgtggacatacccgattacgacatcatatctgcggcaagggtcttccttccgttgatgactcgactggagaggcttgtttggacattcacttcaagtagcaacaaagtgctccatctactgagtaacaaggcggccttgaagcacctgcaggtttccacggtggacaggctgagtccagacttcacgaacctgcagattcttgaaacctgcgaaatcgacaaaattccttcagccgaccggctgagctctctcaccctgcacatgtgcaagggcctgactccacttgatgggctgaccatgaagaacattcgaaagctcaacatctctcgaattcctggacgtgctgatgggttcgtggccgtggaggccatcatgctttcgcgtgctattgacacgtcgcaactaacacacctatcactgacccttcatgatgatggcttcctcaagcagttatccagatcgtcttttgacaacctcgactacctgaggctggatgtgacagaagacactgatactgtcagcaatgcatttcgcattcaagaagagtctggcggaacgcgcaatgatggctgcatttctggcgtggctacatttctagctcatgtcaacgctctctctctcgatttgataatccactggaactcttcggtgactcatcataggcaattctggcccatgtactgcggtgagatggctggcgctctgagcaactcgcagcttcggcatttacaccttgagtgcaaggaggatgacagaggcacacttatgatcccatacgtgtgcctcagttacatcgttgccaacctctcacctcacttggaaggtcttggtatttcatatcccctcctcgacactgaccacagttacaatcgatcctactcgaactatggaaatggcgaaacgttacaggatctcttaaagtaccttaatgtcaagtatcttgatctcctaaactgtggaccccctccgcgagcatgttccctagttggtgggggagctgttgccatacctggattcgaagatggccaccaccctgatgattacagccgcgtcatccgagagatactacccgccatcccatccactcgctacgtgggtattggatcgcatgtttttgacgtaagagatccttcccggttacctattgttagagacggacttcgagagtggtttatcgacaaactcctggggcttgagaatacctcatagtaattctcacgaccatcacgaatcatgatgacttttacgactttcacgactttcacgactttcacgactttcacgactttcacgactttcacgactttcacgactttcacgacctttacgacctttacgacctttacgacttacgacttttccgaccttatgacgcttatgacctttatgacctttacgacgcttatgacctctatgacccttacgacgcttatgacctctatgacccttacgacctttatgacatctataacctttatgacctttatgacctttatgacctttatgacctttatgacctttatgacccttctgatgactttatgactttatgacccgctttatccatgatccccacgatcatcacgaccttgctattacgacactgtttataaagtcctatgacccttatgatattaatgactctaatgactctaatgactctacgattttcgtgacctcacagcacacacaacatcccttcaatacatatttaaaaaaataatcttgatatctattagcgtacaaatctatgccgataccggtatcatagttactgacaactgaaaaattatatgtgtaagttgtcaacattgaggatgccaagggtacttgtatctgcgcatgaggtatgccaagaaccatgagacaaattcgagtgtactgttcttgtagctactggatatcggtagtacaaaagatgcgctttccgacactgtaatgtcaatagaagtttgtgaaataatataccagaataccaaacaccaagctcggaacttagatgatcgtcaaaatattcaaccgtcgtagaatctcgaaaaacaataatgatccgtccgttcagattaaagttggaactgcgcctccacacggcacttgaattggtcacctcaacatcattagtggtatgatagaaagatggcggtgatgctgaagctggcggttgcctctaccaagtcgggttttgttttctgtgatctaatataattgcgcaaagatgcggtatcccttcgtggtttcaccacttataagcctacagtgtgcacacatctgcagtgttaaaccatgccagtccgggggggttctaagcagatacaactttgatcaccagaagggtgcgtgagcagctgcgcaagacacccgacactcacaacccagactttacagctgctaaccacacgttgaccgccacaaccaggatccgttgacgacacaaattaagggcaaattcgacaaaactagcataatcgcattgctataaaagacacggtttcaccatgggaaaagcagcatcgaaactgtctaaggacgagctcactgagctcaagaaagcaacctacttcgaccgaaaggaactgcagcaatggtacaagggctttctcaaggattgcccgtctggccagctgaacaaggaagagttccaaaagatctaccgacaattcttcccattcggcgacccttccatgttcagtgaatacgtcttcaacgtttttgacaaagacaagagcggaacggtggattacaaggaattcatctgtgcgatcagtgtaacctcgcgtggaacccttgaggagaagctagaatgggccttccagttgtacgacatcaacggcgatggtaagatcagctacgatgaaatgcttgccattgtcacggccatctacaagatggttggctcaatggtcaaactacctgaggatgaaagtacacccgagaagcgagtggacaagattttccgtcaaatggacaaggatcgaaatggtgagctgactctggaagaattccgagagggatccaaggttgatcccaccatcgtcagtgctcttaatttatatgacggacttgtctaacgaggtccttgattgtcgtccacaacctatgtatccaatataccttcatattttgtttcattcagcttattaaatgttataggaagcatggttccttttaatacagttatctctttgtaggtcacacacggatagttagctacagtatgctctatttacccaaaacgccaggcagaggctcgctaccaacgctcatcatgagcttgataccgagagtaatggtaatcagagcgacaactgcagtccagaagaaaagctggaactggacgctcacgtcctgcttctggcacaactttcctcctcggccagtcttgcacttgcatgtgtaggcagactcgccacggcccttggagcaagcaccatggcctgagcagttatttgtcttctcgttgcactcatcctcagagccaaatctggcaataccaatagcctgcttcttcttggaggctggtaggccgccacgtttctccttgtttgtagctcggaggcatgagggggcgtacacgacggtgacaggattcttttcgtcggcgttagaaatcagctcttcaatgtggcttgacgaagacgacattatgagggaagccttggcagctccatgcttttgttccagtcggtgactcagtttctgaatagcgcccatatcgatggcggactcaattgcgtaaagagccccagagtcgtcgttagcatgatcagagaataaaacggtatgggagtccacagggcccaatcccatctgaggaagagcgaaaaagaactgctccttctcggccaactggttgccgttgagaccactagacagacccagggtgtcagccaacacgaggtgggcctcagctccattaatggactgttgagcagcacccgtctgggggtatgtagcaatgtaacccatgcattcggatgaggcaatagcggtggcggacagcgccgacagcaaggcgaaaaacttcatggttgtggtgtctcgtcgactgtgctactgctgttgtcaacgcacacgaagcatgaaccctcgatttaaagtttgatgggaggttgttttattggtacgagtacaagcgtgttaactatagaagtacagtaacaggtaacacacagtgatcgacagctacagcatgacttcttgtacgatgacttacggtcctgacatacctagggaggttctacaacggcgccagaagagatttcagcaagctgccagtgcccttgaagtggtccaggctggaccgcaactgtccgaagaggcagactcatcagacgacgatgacttcggtccatcactaacaggtaaccccaacatcagcgagacagaggctctcaataggttagaggagaggagcagaagcaagacatgggtgaatatggaccctgctcacaatcccaaccgggatgggtggatgcaaaatgtccctgcggaactctcagggactttttcgagtgagtcggcgcaggatcgtgctaaggagatgatggggtttaaaaaatagttcaccttccactcgtacattcgttaatacatatttatatacagatgcttaaactcgctcggcgacccaaatggctcctcgacatcctgctttgatggtttccgtgagaagccagtaaggtctggcttcatgcgagtcgttttccacagcaatctcgagatgctccagctcctcgtcacggaattgcttaacaatgcttttcaaagaggtgatctcttcgtccttggaccgctcttccttgggagggaagttttcgtgtaaccatcgcaattgagtgttgtagtgtccaccaataacagtttctacggcttcagtgcaagccatggcaccttcttgaccaagaagggccgtggcacagcctagaccagttgctgcaaccttccagatcggggtaagcagagacggccggactctgtatttctgttgaagctcgttgaaagttcgtctgtggtgctgctcttgctcccacatgtgcttgatgagaggctcgatctcaggcttggttcggctgagaaccatgtactgacctcggtaaataaggtccgcaccaagttctccagcctggtcgacacggatgagtttggtaataaacgaggcctctgccttactgagtgcgtgtcgggccatgtctgtttggaggactgagagaagatgcgtaaggtggtgaagttaacttttgtcggctcatgtccaaattcattcatcccaagtccgcactctgctgcgacgcaggtgtaagactcgaacaggatgtcggacgctgcacatgatagaagtccccaaattgaaatcgcacatacatcaccaggatcgtaggctgctctctacatatccccacctcaattgtcaagacacggggacaccctcaatgactcggaactcacttgctgccgatgaaaactaatctgtactcaaatgccacctcatatgataacgaaccttaattgtgtgatctgagtaagcaactcggcttacagtagatgggaagcatagagccagaagacgaagagggtgaatagaaaacatagtaaaagggctacgagaaccaaattattatcgaaaaaaacaagcttatctatattaccagtcgtctcctccaccataatcatcagcgcctcccgaatacatatcgccgtcgttgttgttactgttgtcgtcataatagttgttcacaaccgtgtcaccgccatcatggtggccactcatcatgtctccaataagcataccaccaagaagaccaccaccaacacccatggcggtagttccccaatttcgtctgtgaggttgctgctgctgcatctgcataggcgggggctgggcatacataggtggaggcgggggttgttggtacatgggctggggcgcataaccaggaccagggccataaccaggtccagggccaccgtatccggggcccggccctccgccatatccggggcccggtcctccaccataacctccgccaccgtggggaccgccgaagccaccagggccaggtcccccgccgtatccttgagggcctgaaccaccaccaccatatccacgctgctcctggtgaggtctgttgttgttgctgttgctgtggctacttccccgagaaggaggccggtcgtatgatggcggactgtggccaccggagccgctaggcttgtcccactgtgattttccgttggagaggtcgacatagtaaaaagtcttgtagttggggtcccatttggctaaccagccatcggggacgctggggggagttggctcgtttggcatgtcgttgctgaggcctgggctggactgaagatgccgtgttacagctagctacgtttcgatcgctgcacttcgtggtcagactttattgggatttgagatttgggtatgggtagttttggccaagtttactactgcactacacacagggtaattaggaggctgtgtcaaatgtgaccggaggctgtgtatgactgatccttcacgtgcgaccttacaagcaatgaatacggtgaaggaataaactcgtcgcgcactattatatgcctctacgagcgatatcatgatatttagatttgtaatacgcgcctttgctccagggaactgcacaacctctcaacaagattatggtggtacagtatcgtagacagtaagtatgtacaaccccacctgtcaccccgaacataaaagtaccatacaagtgtgattgaatagcgccgttgtattttcttgtgggttagacacaactcgacatatactacaggtaggtgattaaatctatgcacttatatacaggctttctcaaagatgaaatttcttcccagtggaagcaaatgcttcggaggtttcggtctccagaagctctgttagggtggtgccgtcacgcagataaacccattcaccgtcgacatagtcataacgcttggggccggaaatgggggaacttagccaaatctgtttgttcgggggttgtttgttgataacgtaggatccagcaccagggatttccaagctcatcacgccttgagctagatccacatccagctcatttgaatcgacctcctcagcgtattcttcataagcaatcaagatagactccaaatattcatccgcttgaatgtggtaatcctctaattccagctcggtcgcctggagagaatatagtcggagcgtttcatgatgtgtagtgatgtgtggcaaagtaattgttcttgtcgcacgtcgcacgccagtggtgaggggtctgcgaagaggtagagaggccactcctgtggctactcttgtggccagtgcgattcggggcactgttcttagcgatcttatcaaactcatggctttctgaaggatcgtggtgaaggacgatgcctgggagtaaagttcgcctcaattcatgcaagatcaccagatcgctcttttctccccacgaatccgagtaatcaaattatgatggccgcccactcttccacggtacaattaaatgttacggagccatataaaatgaattcctaagatgtatgcggcaacctaaacttggctgaatgatacttattttctattttgccaccatattctgaagtatttactgtccttttgaggggtctgtcggcggttcaaaagcccgattggttggaattaaaaatgtctgtacaagtacgatatattattgtacgatacaaggacatactacgatagtacagtaagaactacttgtagtgcttctactcgtacttatacttgtgcgatacattagctacaatcaatatacttgtgatgtcgcatgcccgcaagcgaagattactcgttgctaactacacgtgagatacatttggaagactgcccaacgctgttatactttgagttggtcgtaaacagagtttcatgcgtgcaggaatttgcgatgtagcaacaccatctgggtgggctaacagctggtatttaggctgttgtttcctcagatgagcaatagacaaatacgatattacatttccaaaagattcacaggatacgagactttaaaacatttcattttctctgcttttcggcggttgtgtaagatttccaatttcggtgagtagtgcttgtcaacaaacagtctgaccccttcggcgcatgagagacttcaatagaaagggtaaaccgaagttggaaacataccacacaccaaacccacacacaatacacaacaggcacaggcgacaacgtcgaaacaagacaactcacgataagccgtgcaaaaaaactggcagaagagacacgttcaagacactagagcctttcctggtcccagagcaacccctgttgtccctggtgattcattttgaaggaagaccactgcagtcaactgatacacgacacccacttcgcgccaccaccacagcatattctctactcgtcgagccccaactgataagcggtagtttacctttcaatagttgccgctgcaaacgctcgctctcggtaacacggacatatacaccaccaccccgcaccctctgctcaactcacaacacaagcagcctcaaactacgatacaaaaatgcataccgtctccatcgtcaggaaggacccaaaatctagcaacgctaactatccgctgcggggtacagatactccagactatctctcgcagtttcactttgacgtcaatggcaacgagctccagttcgtcgaacttgggggtgaacagacgtccacctctgccagtctcgagaatggaactcttggagctgcctctgataacgcaacatcccgtgctacggaactcagcaaaaagcgccaggcgtcttgcagcctgccacgccagaagaaggtaccccgaaatgacttggaaattgagcagaccgacgagcagcaaacatccgcatcaaacgtcgccatgccttcgcctcccccggctcgagaagaagaagaagagcaacagcatcttaccattcctcatgccaacctacgggacgaaatccctcagctcctcgacaacttcgacgatctaccagcccctgtcaagaactacgtgatgttccagcttctacgtcgatgcaacagacggaacctgtcgatggtagccgatattgtcgtccctgccttgcgctgcgatttgctgtccatctttcctttggaactcgccacaaaggttttgtcccacctcgactacaagactctttgtgccgcatcacaggtttcaaaaagctggaactccattgttgaaagcttgggcgcaatctggaagggtctttcagagagccaccaggcgcccgttaccgatgctgacgttgccagagctaccgagcaaaagtgggactataccacgtgggggtccgaggacaccgatcctagcattgtcgaatccactcctctgtacagcaagatcaacctgtacaagagcatataccgtcgaagacatcttattcgtcgcaactggatggatcccaactccacacctgactccacatgcatccgaactggacgggaggcagtcattacttgtctccagtttgatgatgacatcattgtcactgccagcgaagacccttggatcaacgtctacgacactaaaactggccgtcaacgaagtcgactcgaaggtcacactggaggagtgtgggctctgcagtacgttggtgatacattggtcagtggaagtattgacagaactgttagaatttggaacatcaaagaagcacgatgcacccacatttttacaggtcacgtctctacggtgcggtcactaagcatcctgactcctgtgccaatgagccatgcaatgtgtgctactgcacgaacggagagcaccgaccccgatgagatgtatccttctcgacctctcattgttactggatctcgggacaagacactgagagtctggaagcttcctcttccaggcgagcctgaatggctggatcagtccactcaggatccctacttcatgaagtcactccagggccactctaattctgttcgcgccgttaatggctacggtgacactcttgtctctggatcttatgacactactgtgcgtgtctggtctatcaacactggaaagtgcaagtttgtactttctggacatcacaagcgagtatatgctgctgttcttgatcatcagcgtaatcgatgcatctctgggtcgcttgactggaatgtgagggtctggtgccttgagtcaggatcctgcctgtacactttggaaggtcacacctcgcttgttggtctccttgacctcaaccgatcttggctcgtgtcggctgcagttgactggacccttcgagtttgggaccccgagactggaggcaacatacataagctggagggacacgcggaggcaatttcttgctttcagcacgacgaatacaaagttgtcagtggttccgcaaaatgcttgaagctctgggatattcgtactggcaaacttgtgaaagatttgttcacggagtgtgagtcaatctggcaagtgcggtttagtggatccaagctcgtcgcagctgtccagaaagacaacgaggcttatctccgaatcctggatttcgattatgagccaggaacgaagactgagaaaacggtctacgttggaaatgaggatgacatcaaggtcgaagacgagcttgacaccgctgccgctcctgatgtagctcaatcctaagtttcatacaagctacatgggcatttacatttgcccacccatatatttaattaacaggatattatttacgatactcgtatcacataccttcatacagtaattctgatggctgtgttttcaaatgagcttatcgggtcacgtgtgtttaaggtttcaatgagatgttagcttttcagtcccaaatcaccacaacacaactcgcaccacgatgaaccccatccggcccagcaaagagcgacttacctcgttggcaaaattgactgcccaggtttttaatcggtcttacaaccccgagaaccttcgacgtggcactaaggccctccgggcaccgctgattggcgagcagatcaagagctactaccccacaagcgacttcagcatgaagagccttcgagaggccatgccccagtttggtttcgcagactacactgagtggtaccgacttaccaacgttgttcagtgagtattagatcctattgtataaaggctactaggtacacgcacaatcgtggttcaattattaacaacaggcgaaagaaacgaggaaagggagcccctaagaagctcaccgagaagaaggcggccggtggaaagaagaaaaaataggcatgctattaatttatactgccatgtacatagacgaaatacaaagcacgtttactacggtgtatatgtttcgattaatttcaacatttctataaattatgtaagtatatcgatggttagatgtagtcgtggctatcgtcgtcaagtgtttcatccttctcgtcatcttgctctgcacgttggtatcggctagctcgtttggacagagctccaccccaaacggagttctcaaacgagtcgatgagctggtcttcctgtctgtggatgaggttcaaatcagaggagtcttggtccttgaaattgtcactgtcgcctgatacgcgccggtcccacatagagttcctgtcaatgtttgaccgttccgaagcccatgagaaacggccagagctgccagcattcgggttcggtgtcattgggtctgtagacaggaagtagtctgctggaactggaacaccatcaggtgttgtaggtacctcttccacatcgaagtccgccgttttcctaggaagcaacgatggctcctcgctggtaaagtcttctttgctgtcgccatcagtagtgatgaaaatttgaggcacaatgttctttcgcgagcccgaaggtattctagtcactcctgtgctctcaaatggatctctcgaagctgacataggacccatatcgtctcgtcgttcgtgaaactctcttctgagttgcaccatatccatgaagcctcgtagttttgccttcagaaggttctcttccacttgttgaagcatgattcgtcgcttgagataggcatctagcatgaagcacttgttttcatcaaccatcttatagatgggaattgccagcagtacttgagaaaaagatatacccttgtctgggtttctctcaagtaacacttgctcacaaagtgtgtcaaaggcccggcgtctgttgatcatgtctccgactgggatggttcgaacggccttgttcagcgcaggaaggtcgacatcataagggtcatggtcattgactctaatgttgtggtctgaaatcagctctttgatagaccaatcgccttcataaatgcacatcgagaaggtgccttcaattcgtcggagaaatctgtggagctcatctggcctaatgtatccagttccggtgggatcaaattctctccaggccttcttgtacttccgcagctcttcccgcttgatggctcgactgagtgggccagtctgctggtagacatacgaaaaattttcgtaaatcaaagaaacaaacatattgacgaagatgtacatggagagaatgttccaagaaatgaagagcagatacgcgtagggacgggatccacaatcagtctcgttgaaaccagcaccgttgatacagtacggcggctccaaaagataatcagacatgatttggttccacccttcaccacaactcatccggaataagagaatcagggccttggggactgttctgaagttgatgtttcctgttccattagggccaactcgagtgagaccaaaaatctgattgaacgcaatagcatataccacaaataagacgatccacgtagccatgaggttcaaaatggatgcaaaagaagctgacgtggttttgaacagctggtcgagtcgctctgatcgtggaatgaaaagtagcagaataccgacttggcacaacttctggaagttgtagtaagtgttggaaacgaaagaagcaaaagagaagatggtggtcactaatgcacccgtcacaacaagtactgtgtagagatcccattttctggacatgaaacccttgtaaccaaaagcataaaacctcataatctcgttgagatccaggataatgaggatgggtagaaagagcccatttcgaatgtcttcggcatataggtattgaggataccattctaagcacaaaataatgaggtggataaacaacagacccgcaagaaacttattccacttgccctttcgattcgtcactactctgtagcagtattcacgccatgttccctcacgcacgtacaccggtacaatggacggttttaccagcttcaggattttttcagcctctgcccaagcccgttgctcttgggtaagaaatgccgtacccgtggttctcgaataattcttaatgatgacagcaatgaacaacgtgagaatgaaaactgtggaaatgaaattgtacaggacaagaaaggccgagttgttcactgaagcggcccactccaaattcatcccaggcccttgaatactcatggtagtcttgagaacatccgtccaaccttcgagggaaatgatttcgaacagaattagaaaggaatgaccgaaattgtcaaagtcatagtatggcttcacaacagagcggggcgccaggacattccagtttgacggcgaggatgcaaattcgttgatacaattggcaagaaattcggtattttcgtcgttgcagctgtagaagcgccctttaaagatttgcaagccccacacactgaaagggtagagcagacacatggaaatcatggccgcgccgaagatcttcctgatgcccacgataacgatgttctcgaatgtttccttagctgcattcgaaatattgagcaatcgcaaagctcgcaaagctttgaaagcacgaacagctcgagagacgtaaccatttccagcaaagatggcaatcatgtttatccacagagatatcagcactatgaagtcaataacaccccacgacgatctcaagtaggcattgggtgtgaagtagaatccatcagccaaaatcttgataatggcttcgatgctgaaaagaatcagaaaacccaaatcggaccaggtgatccaagaccacaccccaccacctccattctccttctggtacaacggagtagcaacacatgccaacacaactagggcaacagtagcaagaaacataatgaacgtaaatgtgtaccacacccactgcttgggaataacaccatcatgcctagttccatgtgatggcattacaatcctttggcaaaatcgacgaatagggttatgaggaggcaggcagtatagcaccacgttgaaatccggatgctcagccaaaaattcctcctgagtcttcaaacgctgctgataatcatccaggaaatcctttgccaaatttattggatttaggctcttctttctggagaaaaaatctccaccttgcgggggatctaagaaaggattttcagtgggttcctttttgcgccaaaacatcaatgacttgacatgtgcttgtttcagcatgcgcttgattcgcgatggccgcgatcgttgttcagccggcatctcctccgcctcattcacctcgtcttctagaaaatcttgcacaacgtgacgttgcatcaacatatcaaacacgtgtgagccgtctgtttggttgatctcccggttcttgccgagatgtttcactttttgcatcaatagttgcatcgtcggcagggatccgccgttgttgctgatctggtctgtgtacttccggacgaagcccttgatctgttcaatgcgcttggtttcttcagacacgtcaagattttctgtaatcagagcaatgaaaaggttcatgacaacattattggaaaagatgaaccagccgatgaaaaaagcagcaatgcaaagagctgagaaggtgtttgttgcgaactgctggccattgtacagcatatctgtccaattctcagtagttgagagagcatacattcccagaaaggtattctgtaggttgtaaaatgaaaactcgatcgactcgccgctatcgtcttcttgcggaattacaccacgcagtagtcgagttgacatgacagaacagaggaatgtcaagagaaagaagaagcaactcatgtaaaacatagttctgtagtttcccacgactcttctccacaggagccgtgtgaatttgaagaacatcacgactctgtaaatccgcaaaatttggaaaatcgtcagccaaccatatagcacgggcttgttgtgaattgggggaatcaggatgacaatacacatgactccaagagcacaatccaccacgttggcaatattaaggaaaaatatgcgccagttcggcaaatagacataaaaccgcaagatcacgtctgctgtaagcatggaagtgattatgatctcaagaatgtagagcgctgtctcttggctgtctgtagtatctgctgttcttgtgctgcttacgacaagagacatgaagataatgagactccataaccattccatacggagataccagcggcccttcacagttttcttgagaaaattgcgagcctctgcggaagttaatctcttccgaaacagggtctctgtcttagacttccgtgatagaatcatctccacacgaatttgcgaataagacgtggcgataactgccaccagcaagttagcaagccacagcgccaggatgagaatcccagccataaaaaataaacaggcagtcatgtagtcactatccatcgtatagtacatgatatcggtgaatgtgttgagtgaaataatgacgaaaaccatttcaagagaattaaaaatgttgtcaaaagacactgtaccaccgtatggattcttatcgctgacacagatactgccagccgggcacatgtaccctttcgattggggtccaacagtgccatcagtgaagacatatggcatatgctcgagcgtctccgggtgaagatagccaccgcagtattgttcataagtgtaattatcctgttgccctgtggagtctacccaaacacattgtcgtcgaagagacgccttgaaggattgagttccaatgatagagaaggtcaccctgattgttagtagctattgaagatggatgtcagtgtgaagtcatcgtatacataccagaagaagccgatgaataatgaaacattgatcaacaaaggagctgacgtttttagagctctcagcacagcggtggtgccatgtgtcaaattcagcaatcgcaaaattcgaaggcatgctaagaagcgaaagagaaatagctggtgaataatgtcgtagtcgtgtgcagccacccccagcgagatccaatagcaaacaactgaaatgaaatcaactcgattccaactcgaccggaggaaagctctttgaacacgatgtgtgggttgttcgttatgcacaagtaaggtgagggcgtggctgattggagctgaacttgtccctttgcgttggttccacctagatgatttggtcagcttgttcgggaaaaatctgttccacgacgagtctggcatttggccagtggagtaaaacatttgtgaatcgtcccagagcccaaacgcaactattttagctgatatctcgaaagtgtacaaaatgaaaattgcgagaaatccccagtccgtccacttatgaccccacgaagcgaaaatgtgttcagtgtctttgtctttaaaaatgttccacgatgattcacagaacaagaagacagtatgcaaaataatcagaagtaacacaaaaggctcgaaccacggggaactacatagcttccacattttccaccgccaaggatgctgaggaggaaaaatccgtagagaacgtccaaacaagtactgcgatgggtcgtcgtagtcattttttggagtagtgggtcttcttgaagatgtgtttgagttgaacctgtggggacttggcctcacaggagatgtgggacggagtggactacttggccgcaggtgatcatactgtgtgaagggatcctcctcatcaccatcaatagtaccatcagagctctctctgtcctcttcgtctgtgactatttcatcgggatcgatctgctccatacccgaaatgatacggtatgagactctctggacagctgaggtcaagttgttccatttatcgccggtgttatctttgctcttgggactatttctcgaaactgctctctcgaggtcggtatttctcaaatcgttgtgcatcatagggtcggcagaatcaaatgaggtataacgcttgggcgtatatgcgatgttgtcgagtgattccagttcaaagtcaacagttctgttcggtgtcaagtagtcacttgatgaaggattccatcccacttcaggtcgcttcagcccacctttggtagactttgggctctcttcgaacactgaagtccgtcgtttcttcggactcagcttctcgtcattgtggatctgctcgctggtgagccactcgcctcctgagcccccctcacctagagcagtagttagaccctgtcttatcgatgcaatcgatgggttatctgttgtagacccggactctacgctcgaaagagaactgttcgagcgtgatgctgcgcgtctagttccggaaccaggatctagaaaggggttgttggaggaccaccttcgtccgctcccttccacctcttctagagggatatctgagtgttagcgcctgttgaactgtagttgtagtgcttgcaatactcaccttcggccatcgcgcgtaactgtttgtcaatgtcgatgttggagtgtgtacctgtaccgatgtctgattttaacgtttactgcatcacgtctatggttataactgtaatgtggcgcacccagatgtattagaagtatcgtggtctcgtacttgtaccggtaaaagtgttggtaagaaaagttttatactaaaggtcttggggtcgtactgtagctacaggtacgatactgtactcgtaccgtaatttcctggtatacaagtatacttgtactttttaattcaggttttttagctaatttcagtctcatgttctttccaccagggcaagtcctcacgaagacatcgcagaatcgcgttttttgacattacatgagtggtattcataatgaagctcgtttttttaatccctcctacaacgatagctaacttgtactgttgtaagactcgttggatcgggattgacggctgaaatggctctgacaacgtgttcagggtccacccctccattgagggcttgcggaaacatttggtagcggtgcctttcaaaccgtacgtagtgtacaatcctaccttggctttagaatactgcaagatgctagtttccatacaaatacttaattcttatattgagacaacgtgtttcttctatcgatatttacccttgtgtgtacaacccaattattggacacccgacacccgtgtactgattaactccttgtacgcttgtagatgtattgtataacatggggctgtcgaaataatgtctgtgccatcagtgtgggattccagccttcgacgaagataccattacagtagaagtagctacttgtagcttttacaaattaatagaagtgtgatatatattatcgattttatgtagagtggcttctggacttcgagccatcacaatttcattcggccaagaagaatgtgtataaataatcctccctctattagcccctccgagatgttgctcctggaggcggagcttggattgcctgttggggaacgatgtattggttctttttcgcttgaagagccagcaatcgttcagtttcgtcgccatgtctcccaccttttccatcgtgcttgaaggcatatgtgactgttatttgctggttcatgagatactgtttgtccattgattccaatgcacggtctgaatgttcaaaatcagtaaaagacacaaaaccgtacccttttgaagaaccatctgtgtcacgagatattcgagggggtttggcaaatggtccaaacacagagaacgtttgctgtagtgtagactcatctacgagaggatccaaacttcccacgaaaagtgttgctccaatctcaaacccgttttgcttgtcggatgcagatttgctgactcgaatggattttccgaacagccagatttggttcataatagacgctgcgtaatttgcatcagcctctgttttgtactccacgaagccatagccttggtgtgtctggctgactctgtctttaggaagattgatgtgcacgatagggcccgcttgaagcataagttcatacagaatcgcttctgtgacgttctcgtcaaggttgcctatataaagagtagcctcagggttctggtccgcttcttgttgattcactctgttcatgaaagctgtcgatttggcgcgatgtgtgagaattcaacacgattatgcacgatcaatttaggttgttagtaataaaaaagtcccaccacgaagtctcttgatcgcaacttgttttattttattttttcatccataaaaatttttatacctgtaataacattatattgggggagggggcgagatccaatatatatattttataatcacataatacagtacaagtattcgtacagtacttgaacaacactttgttgaactattaacacatcagaccctctactgatctcacacttccggtacagtatgtactgtacttgcagtacacagcgcgatacattactctacgtttttttttatggtggtggtcctaactgaaactataacagtattaactaatcttaactcatacatttcttaaaatttacttaactcgtatcacttggtcagataatagcttagagcttagcatccttggggaagagctcaatggcggcattgctgatggcggtagtacctcgctcaacaaccttggtctggaaaatgaccttgttgccctccttccagccctcaaccttcagggtctcaccagggaagacgtgaccagcaaatcggaccttagcgttcttgaaaggaccaaactgatcgtaaagagccttaccggagacaccaaaagagcagagaccgtggagaataggtcggtcaaagttaccaacagcagcaaaagcagggtcgatgtgaagagggttgtaatcaccagaaagtcggtaaatggcagcctggtcctcctggatcttgatctccttaacgaagtcaggagctcgagcagggggcttgttggcagcagtggcagcgccacggtcagtaccggtagacttaccaccgaaaccaccagagcctcggatgaagagagaagactcgttgtagaaaacctcctcaccagtctccttgttcgtggtggtggtagcagtgacaaggagggcagccttgcccttgtcaacgacatcgatgaccttagccttgttctccaatgtagcattggtaggaataggccactgtcggatttcaaggtactgctcaccgtggagaagcatcatagggttgaagttaggaacgaagtcgccatagttggtagtgatgaggccacccatgtaagggataacaccgaaagtgggcacggtctggaagtcatcatcaccctcgaagacatacttgagctcattagccttggcaccgagaccaaggttgtaaagaatgaggtctcggtaagtgtaagtgtagtcgaaaggttcgccctccttgttgaggataccgggaccaccgggaccagcaacgagagcagtctcctcaacctcctcatcaggcacgttgaagatgttctcaagaatctgagtagtagactcggagggagtggtgggatgggtggagttaccatcatcgaagtcgacgatcttagcccagctgtctcgaaccatttcgggggtgacacccttcttggtgttgaaggccttaccaccagctcgctgccatcgagtctgtccgatccaagcagaaccagtctcaaacagatcaccggtgacgggagcctgatcggaagcaagcaggacggtgatgggtgcgatgaaatcgggcttgaagagctcgagcatctcctcagtgaagacagaagcagtcatggcagtaccagcgttaggggcaatggtgttgacaagaatgttgtacttctcaccctctcgagcaagagctcgggagaaaccgaggataccagccttggcggcagagtagttggcctggccgaagttaccgtagataccagaagttgaggtggtgttgatgacacggccgtacttctgcttaaggaagtggggccacgcggccttggtaacggagtaagtaccgttgaggtggacatcaaagatcagctgccacatctcatcatccatgttggcgaaagacttgtctcggagaataccagcgttgttgacaacggcgtggacagcaccgaaggcgtcgatagcggtctgaacaaccttctcaccgtggatgacgttgttcttgtcagcgacggcgataccaccgagggccttaatttcatcgacaaccttctgagggttaccgaaatcgttaacaacgaccttggcaccaagcttagcaaggaggtgagagtaagctcggccaatgccagcaccggctccagtgacaatgacaacctggtccttgaaggagacggtgggtccctgggggttctcgggtcgcttaacagactcctcagcgtatttgaagaagtcagcagggccgttagggtaggtggggctctcaaaagaggtgacctcatcccatcgcttcagaatagcagacggggtgaaagtgtcgtcgcccttgaaaacagcaccgttgcctcgctcccatcggattttagccatgtaaccagcaccgacctcgtaaataccataagactcggtgacagagtcgtgggtgaggtagccgaccagaggaacaacgtactcaggcttgaggagcttgaggatatcctcgggcatgactgtctcggtcattcgggaagcagcaagaggagcgatgacgttggaagtaatgttgtacttggcaccctccttggcgagagtctcaccgaaaccaaccagggcgagcttggcagcggagtagttggtctggccgaagtttccgtaaagaccagcagcggaagaggtagagataactcgaccgtacttctgctttcggaagtaaggccaggcagctcgggtaaccttgtaggcaccgaaaacgtggaccttgtagacaagatcccagtccttgtcggtcatcttcttgaaggaaatatctcggagaataccggcgttgttgatgacaatgtggacggagccaaaagccttgacggcagtctcgacaatcttgtcaccgttctcgacagagtcgtagttagcaacagccttgcctcccttggaaacaatctcgtcgacgacaacatcggcaacctggtgttagtttatccttctgtgtggtgtcgttttgggtcgtttcgcttcgctgcgcttgtaatgatactcactcgcttgccactgccagcctgggcaccgtcgcccttgaagtcgccaccaagatcgttgacaacaacagaggctcctcgagagccgtagaaaagggcgtatgccttaccgagaccgccaccggcaccggtaacaatgacgacctttccgtcgtatcttagttctccagacattgtgtgtgtgtgttgaataaatagattgtgttaataacgtatcttctacctcaattgagttagcaggtccggtataacttgatctagaaagcagcaagtatggaggggtggggcaggttatatactggggtcatgcagtggtcactttggcttcctatggggtttatggtttcgttgtcccgatttagactctgcctcggctcaagcaagtcgctcgtcatcgggcgggcgtaatccatgttggcaatacaaccgcaaccacaatgaatttagggagaaaagggtcctcaattgttcagagctatcttgtgtgattccattgtgaatttttccgtatcaatatggagtacaaatattcggttgttctcattttctcgaaaatgtcatcaatttcaaagttgtagaaccccacatccatacagaagcttgtggaaatttcaacatgaaccaggaaatggttataaccgattttacgtttaaataattctgactgggaaacggcatgacctacgaaatccttctcctcttcttggagggtttccccatctctccccaaagaggttggctcggggttggccaacctccccatggggatctgcccgttttcatgctcactctggcttgcattagctcatccaatccaaataagccccgtgctggaactcaaccccacattacacaaatcagccgttggcctgcgacaacggaaatgattactagacaattgctgccacttgacacatgtggtaatagtgacagaaatgacaattgcgacagagtagcccatcaattgtaggtctatctatgttccactagggaacgccacccatcgtaactccgaaattcagattttttaccttttctcggtaattctcatatttataccgaaaacactggtcattgcagtactccctacagtccaataggcctacttctaccagtactgtagtcttactctaattcgctgctggagtcaacatctctttggcttgtacgtcgttgtcggcgcattcggctccgagccttcctcagttgtcggctttaccctctccgcatttctggcgcatgcatgatctcaggagatgtaacagtgtttagacagcaaacatcaaacgtgttcatctcacaatttcactactatttgtatattcctcggatatggataatgcacttggtgacaagcacacagtttgtattttggttggatttcggttttgtgctgtacaattagcaaatccgagtatccaaccccacacattgattctctcggcttgttgcatacacagagttcatgtgccgaaaaaaaacgggttgcccgcaatgcggggcaactttcacgttcgttgttgcattagaacctgtgaaagcataatcaactggctacaagtaggtacaatacaacgggtacacatcatggtggagggacaaggacagctaaccatagtacaagtagtacatacggtgagaaaaaagtacgtcgtcatgtgcgctccagattaattgcagagcgttctttggtaaaatgatctttagaatgcggggtacatggtcgctgtccaacccgtattaataatactattttgtgattggcatctcattggactggatgtgatccaatcaacggtatccttccaacatggtgaagtagtattgccgaggtttgtaagaaaggttctgtttggttctatacgatgggctgtggactactgagctcctgtggcgaagttcaactgttggattaaattaacatcaaattagatagcaagtcccaatcccagtttgaagaaaaccgcaaaacccctaacccttgtactgaggctgtcatgtgtgtgtgttaaaaaggtatagtacatataagtatgtacttgtacttgtacctgtccttgtatataattataaccatacaaaatcccactggtacaacaacaagcatcgtatgtacgagagtactaaaagttccctggtagctctgacgtttcagccaaaagttctctcatattaatgcggatttgtggtaaggtagaaagaggagtacattgtacaaaaggggatgtgacgataacctgtatttatctatattataaaggagttgggccgcttatagctttgggcgaactgtggttagtaaaaatatcatatcataagaaaattcctgacttcaaactggctgctcctagccctaaaacgatcacccagaaccatagcttaccaaatatccgctccaacagggagcggtcaacctttcctgttcgaggaaaagatggagcagctagactaccctggacagccttttgttttcgactagtgtagggggcatatctgatcgccattggtcgttcgatgaaatggggctgcttcatgaaagtctgcctgtgtgaaaaagccaagaaggaatcttcgccgtgataagacccatagccggattggccgacaccaccaaaaggcgcctgcacgcagccaacgtgaacaagactatcattgaatatcaggccacctgagttgatttgagattggatatactctccttctgatgcattatcagtaaagacatacatggccaggggagtgtcgtgattctcatgaacatagcgaataccttcgtcaacggatctggctgtcaggatgggcaggatagggccaaagatctcatcattcatcaaagaatcaccatcaggaactttcgcaacaactgtgggagcaagaaaccgtgatttctcgtccgaatttccgcctgtgatgatatttccctctgtctgggcaagcatggatgtcaatcgtctccaatgtccaggtgttgcaatatgagtgaagtccttatgatcagagtcaactccacctcggtagaacttctcaacccagtactggcaagctttgataaactcctgttcgacctcaggctcgacgatgatgtaatcgggggcaacgcatgtttgtccagcgttgaccagtttaccccacagagcacgcttggcagcaagagatacgttttggcaattcttagtcacgaagactggtgatttgcctccaagctccaaaataacgggggtgaggtatttgttagctgcgtccaagatgatcttgccaactcgatgatttccagtgtacatgattttgtcgaacttgtacttgagaatctccgacactaccggaacgcctccctgaaatgccttgaaaatttctttatcaagtgcctctgtgcacaactttcccagcaaaagcgatgtatgtgggcacatttcggagaactttagggccaccgtatttcctgccgctagagcagcaagcaggggagagatggtcagaacaaatgggtagttccaaggagatatgataaggacggtaccaagtggacgctttctaatctttggccgggtgagagtgtattgaatggtggttcccttcaccgtctcatcagctgcccatttcttcaagttagaaacgacattattgaattcaccccactgaaaggagatctcgcaaagttcagtctcgaagaccggacgtccgagatccttatgaattgcttctttgatcgcatcgacattatcatagagagcatagaaaagcttacgaatctggtcaagcctgaagttcaaatccagcgtctttccggacctgaagccctgtcgtagggtttgaatatccttctcgatctcacctagtggtgttgccggcaaaattgactcccaatcgaactctgacatgattggcgttgtgttcaaatgttagtaaatattaatattcgtgcaagtacatacgtccttatatatattcgtgttgttgagtatggcagctgcatgggagacgcttcaaaccttgtggattcggtatgttccccacactaagtaagttcatactaatcagataatgtggcgattgaactgtattatttcacatgatgagcgtgtgaatatgaaactggcagattgatatatatcgcttaattaacgaattacaaagtgagttccatactgactgcagcccagatcagctttccttgctttcagcagcttcattgcaaggttcacacacaattcctcacataatgatgagatgtcaccacatagtaatgagaggaatcagctgggtcgtagacgagatgtccatcctgtagatagttttatccactgatctagaatctcttttctggtgaatgagcaagcacacacctttctggtgtgtgctactatcggaacgccgtgtccctagaagtgggttgtaagttgttaattaactatatcacatcaataatacttatgatcttcaataaacttgggtggcatcagatcccagtcatgcccaaactcccaaaatcattaattaattttgttgacttgtttataagaaataataatattcatgtctcgacaatgacaaataaaaatcagagtagaataaaataaaaattatccacaccttttttagaaaaatgttaagataccacttcgacaaaaacaaaaatgttgagcgaaaaaaggaaagaaaaaaaagaaaaaaaaaccatgtcaaatgtgtggctctcgaatcgatcagtaatagatatggcaatctatggtcgcacttcccaggactaagcaaatgactaaacacatattctaaacaaatccatataacattattgatatcacaacctctggaaaaaaaaagtacttcctaaggggtgattggaaataacatagcaaatgactaaacaaatattcaaaactacatttgacgttattgatttcacaacctctggaggaaaaatagtacttccgaaggattgattggaaataacataggaaacaattaatccattttctgtaaaattgttaataacatatttttaattgattctctaaaataaatcatgttgactcattacctgtcagtaatgttgtgtatgtaggtatacagggtaaaaaaatatataaaattgtaataatgttgtttgaattttaagttaatatactaatacagtaaaatgtaacacacaaaccaatggaactacagaaagttaattcaattgctgaagtacaataacttcactataaattcaaaatacaaactagagcaacatttatagaagaagtatccgtaggcgcagcaatcatatatatatatatatattaaatataaacgaaattatatacatttatcaaatttgaacggatcaaaatacaaattgctcaaaaccccatcgaattccaaaatacaataaaatttaaacgaaacatactaatatcaatcagataaaataaatcaaattacaattgaatcatataatctatgtccaaaatatatatagactctcgggtaaaaatgaatgatattaaacgactacataatatcagatcagttggtagaatgtttcccttattctactgtggtatatatatatatttttcattgttatgattaaaatatctacgggatggtttcataattacctcgtatgaattctattctattactgtcatatatatcttcttgtttgttcatattattaagagtctttcctttcattcggaaaagactaacgttattcacaaatattcttgatttactttggttttgccctattcggaaattttattgatatctaatagaagtattaaagtaaaaatgtactaatacttaattgtaatgtcatcagaaataacatttgaggaacatttttcaaacctaattgatatatatattagagatgtcccgcttctctgtcattaatatattcaagcaatcgatgatattgtggaaacttttttatcctattacaatggtgtatatatattgttcgttcgcagcacattcttctccaatcttggtctggtgtatttgttgtttcaataaaattctttccaacttttttctcgtatcacacaatgtatagattcttcaagcagtttctcaactttctgaagcaaatctttgttttttatagttttttttggtttgcttaaattaaatttttgtcagatgattcgatgtattcttcgtggtttctcaaaattttcccaaggaatcttcttctttttgcctgtttttttttggcctgtttttgtttttcgcctgtttttgtttttcgtctgtttttgttttttgcaagatacacaaaaaaatatacaacttatataaaataggtcatatccgtacactgatgcgaaaatatatttttattaagaaaagacagttatcggcgtccttttcgctggacaacttcgaatccgtcatcatcgattacagggccctgtttctcttttgtacccaaatctgccatctcagaatccccgtccacaaggtccggtgcatggtcctcctcgtcttcgctatcaccaccggtagtctggtcgtcgaccttcacgctggtctttgtgttcttgctcttctcatatttgttgtactggttttcgaccgtagagaatatgccctgtgaacattccatccagatttgaatcaacaattgtgcagttgtgaaatcactgtcgtcgtccacgactgtatcgaattcgtcttccatgacctgggatagtctagtttgaatgtcgagcgcgtcgagtactgttgattcctcaaacagttcgactatgttccccacgagccactctcgcttttcctctgagtcagatcctccccagctgttatcaactgctgtggtgaggtcagtccagttatacaaggccatgcatacgccaagctcgaatcgagcctgcacttgtgaatctccgaacttcagtccgttggaattttcgatctctaggatgtcggacattgctgtggtctggctacttgtagtgttcgttgcagttttttggtggcttgtacaagtgaagtttcaaaatatttttttcctgcactgtttgcatgtcagtcagtccggtaaggtttcgttcaggggccaatctggttgtaactgacggcgctactggtattggtaaggtcgagaattgggcgtgttgagggtaggtggagagctgacgaccgtggttgtgacgagtattgagcgttgcgtgtactgtaatacaagtatgaatagttgcgctacatcacctacattgtagaatatttatgcgttctaatcagaacgtacatattccatgcactgcactactcgtacttgtactattacaccagaacatcgctacttgtacaagtactacaggtagccacaagtacaagttctgcactgtacatgaccccaatatgcaccagctcatccaaccaagagaaacggcaggaaagcgaaagtccttacgaggccacgaccagtgcctatgtacggcacaaatgcaccacacactcgcgacacacatgacgggactccccgaagattgacttacaccttatcttacatctacccgagtgcaagtctctcattttcatcacagttggaccagaaccctacacagctcgatcacagctggcgccatgtccttggtcatctggtcctgggaagtgagcttgggctgagaaatacccccaaaccaaaccgaaccaaatcaagcagccgattgtttaccgcaagatgaaaaaaaggtccgttgtacacaaaattgatagcattggggttcagtgaaaatatgtgaaacaagaaggtgtgttttttttggaatgcttggaagtcggtcagcagtccgacgctacctttcagttagctactcccctagaatctctctacacggcgagggctggttccgtagaactgcaacgcacgagaacttacaactccatatcgcagcgctactacaacgggtactaaccagcctatcaccgagacatagccacagcgaaaactgtgtcacagcaagtggcaaaaaagcgctgctgatagcgatgaagcgcactcacacagtggccttcagagacctctgagcacggatacgagtacatactggaatgtctctgaggcacatatacattgtgcgcgtaaaagtagttacttgtacgaggaggggaatgaggcttacataagcacatatacacttcgtgcacaagaagccatgacagaaacaaatatgaagttaccctacctacgtccctggaattttggggcaacctaatttcttgtgctgaacgtggtacgtactgtactgtacagtatgtactataccgtacttgtaccccactccatttcgctaatgcaattctcggataattgtcccagtggattgcataatttgtaaatgaacaaggagaagttggttttagctgcgaacgagtggcaaccagagaagcccatggctgcaaaatgtataaaaaagatgcagagttatctccaagaatggaaattcattagtccgtgagttgtggggtcgtgtgacagaattccccatatattgaaggaggctgacgtccggctaagttcatgaatcttacatgttgggagacggggatgaatatctgcgcgaaagaacaaatactcgtcgaaagagtaacgtacagtaactggacccatgtgaacccgaccacactcggattaaaaacacattgctgcgcaatcaacacaggtgagagtatttcaccctgtgccctcgttctaagtcgttcccgcattacagcgaaaaccggagaaactaaattttctagctgccggcaacaatatacagtatgtacatacatatacaggtggatacatcagtgtgtgcgaggaacgacctggtacttgtacggacttggaggcaactatcaatcattggtgaatacgctgtcaatgctctagggttatccggaagatagcaaacatgcgccaagcgttatacaatccaacaaggtggagccgaacacaacacagcccgtacataccatatctgatgaataacgccttacgcattgctcaatacgacctacatggacaaaagctaattctcactccacgcgacagcgttatggagagtggacaatgagccatcccataaaattcatgataaaggcaacaaaacaatggtggatcgattgtactcacaccttggggactcgagcagcgtagttatacagtatacaggtaatagtttttttttctggggactcacatttgaagattgcaagtaaccattgtgagggtcagcagaagagatggtctccgacgacttagtcaagagaccccagtttctcggactgcactaattatattcgcctgtgactaagacttcagcagtgtattactagttacttcgttatgggctatgggcttccaaaatttacatatctatagagttgaaaccataattgctggtgcgcaaccaaaacgtatatagacgcgggggtatcttctttttgtcatacttgtactgcctaatgacaatcactctgagtcagaaggttggcgagttcgcctccgagttcgccatcgatggcagctatgttcagcaaggcgtcaaacacttcgtcgatcagacagcacaggccctctcagcaaacatggaaagagcaatgcccatgattccctcgtttgtcacccgaattcccacagggaaggaaaagggtgtccagttggcagttgacctgggaggcactaacttccgggtctcatccgtgcacctgaatggtgaccacacccacaaaacggtggcatcaaaagttgctgtcagcgatgacctcatgactggcactcaagctgacttctttggatttttggcccagcaagtgaaagatttcttaacagaacaccactcagaacatttcagccagactgagcctttgcgaatgggagtgaccttctcgttccccgtcaatcaggtagctttagacaagggctatcttttgagatggaccaagggttatgatatcaaggatgctgttggaaaagacgtcgtggagctatttcagatccagctcgatgctcttgacctgaatgtgaagattgtggctctggtcaacgacaccgtgggcacactattggcgcgagcttacgcctctaaatccgacgatggtaagcataagcagaccttgatcggcgcaatctttggcaccggaaccaatggtgcttactcagaaagacttaagcgggtccccaagtttaccgctgcgaattaccctgaagttttcaagcgctactcaccagagcacatcgcgaaccaaactatgattatcaataccgagtggggatcttacgataatgacattgacgtcctcccaaacaccaaatgggatattgacttggacgaaaacactcacaacaagtcttttcacatgtttgaaaagcggatttctggaatgttcctgggtgagctgttgcggctctgtcttttggatttgaagagtgagggcctacttcttcaatccacaaagttggaaggaaaccctgtttggaagggatttggaatggacacttcggtcttgtcattcattgaagcagccactgaggcacagatcgagacaggaaagggcgactatgagaaaatcatcaaggccatgggtctggccgccaaggacatcactcctgaacaagttgctgccctgaaacccctggttacggctattggtagacgatctgcgtatctatctgccattcctttagctgccattactcttcatactcacgctttggagaaattcgacgttgttgacattggagttgacggttctgtcttccagttttaccccaaatttgctgatatggtgaaagaagcgatgggctatgtcgagggtatttctgttgaccgtatcgacatcggccacgcagaagatggctcaggggtgggagctgccttggctgcttacccggacgactcataggaaggtactttatgtaaactcttatgatggaattgtgggaatattataaacacgggaccttgttatcgtagtgagagtggcagcatgtagctacttgtagcatggcgttgatctctaccgctatggagactgcgagactcctaaagacattctatacaggtatgtgccagacgtgaaataacgccgcctacagtgtacaatacaagtacaacacgctgcatgactggaacattcgtacttacaggaccactcatacttcttttatgcattccttgtatgggtgtacatactgtgtatttgtactcgtactgtacatactgtacagtatgtactcttactcgtctgtacgatacatgcgcggttagtgagcttgcagtgagccatagtggacaggaacttcaatcggttactgggaccaccggctcccgtgtcaacactcgaaatacctaacagcagaaccatgtggttcacccatgggggtcggaaaacgaacccttctcatctcgaagagatctattgcaccacgaatcaaatacaagtatgtacgtaaacctgcatttgttccacattctttacaataccggtacctgtgtccatgagttaccaggttacagctgggatttcatactaatatatagctgcaattcctttctggaatacagtatttgttattggagaagccgttcaagggaacatccaaataagaacgtgatggcgtgtgggcatgccatgcgatattattggattaaaaagtaaacatgacagtccctaatggttagacatatggaggcctacacaccgcagtggttggtctcatcagtcactacaggcgtttttgtctgatctgagtgcatctccaaagtcgcacccgtcgagacccaattccgacggctggtcttttttatcccaccccccaacaacacaataagaaggtatgtggcagcgtacttctaatactcagcccaatcgcacctacttgtagctgatctccttttttgggtcttcagcaagcgcacatggcttggattacgtaatatacattgtgtggttgtgacatgcgtaagaaacattcggttcaatgatatatacagtagctacgaatacaaataccagtacaagtacatactgtacatatatctaccacgagaatccacaggtgttttttttataaaaactatgacttcggaattatgtaaaatcacctacctcctgtagagctcaattgtatcgttacagaacactctcctacgaatagttttgaccagttgcgcccgagaactcgcagttgctgaagaaccacaagaacacacgatttgtacgtcctggttgcaactgcatgcccaatggtgatcgcgtattcgccaatttacctgacaaccccgacaagggccgatgacacgattacacttttgaagttccaaggatatgattactgtaacttaaaaaaaacattaagtagatgatgacagcccattaatattggcggaactaccgtattcgcgtgtctgcatctatgtactatctcaatttctttgtgttgaacgtgaatcacctgagatctcaacgaacaagggctgcctggacgagagcaatgagtaatgagtgatgcaatgctgcaaggagtagaatctggcagccacgggcactgcggaagttcactaaaggctcgaattttgtgttccggagcaacatgcgagaaaatagatttccaagttcgagtgggtggccgtcttgggtgggtggtggctaatcatgcttgtcactgaccaacttaacctcgtcatttcataaccgaacttgaagctttcatatcagagtaaattaaatgctcgcctgacaggacatcatacctgtacgaagtacttctacaagtagcagggtaataccttgaacgattcgacggcacagaagttgccaagcaatgatgacacttgacagctaggcctcgacagttgtctggacaggtgattggcagctgtcggtcaatttttttaagcactcgtacatgcttttagcacttgatatttaaagtctggggtactcacctgacactccgtatactgttgacaaatgaaagccaagctgaatagaacccgcatggaaccatgcagagactaaattaattaattaatatatagtatatagttactcgtacatactgtgggctacttgtagaagaggtgacgtgcccatctagaatacttgtagctacaacacccccacacatgactattacacgcacgccattctataagtgcaagtgctcgtacttgatagttcatcttcacagactcccttgaccacatgcgctatctaaacagcattcaaagtccagaacgtagcaagacaaccgtgctaacttttttcgtgactctgttctccacggtcaggtgtcgtatacgtaagtactgatactcgctcgtactggtactgtgcggtacatacacagtacgttggcaccagtgacaattgtgctatcgatactgttataagcggcttctatccatggtttactgaggagaaatgttctagcagtgacgttacaagtatcgtcactacattatgttgccatgttcgcacaatacaacatacagacccgttttcaatgcgacgtatacgttcaggtaccttcagtgcatgtgtatgtaccacattatacgaaacagctcgcactatataccatgcaacttgtacaagtatgggccacattgtgacaccaatacagaacgcacaaacggtacaccgacgcaggaagtttggaagagcgttcatgccgattgtgtactcacagtaccagtacaatacaccggtacttcttccctgtatcgtacgaacttgtactcctagtctaaatgacctcaaactcaagacatcaaacacttagcttttactacggtaagaactgtatacccaatgtacttgtacgccttgaatcagtcgatggtctggcacagaaatgaccacacatacccagttaactaagccattttcttcatcagcgatggaaatgcatttaaagatggttctatttcatacaactacccattgactaatggttattcttgtaaaatgatggagaacttctactacaagtacaaatactacacgcgaagttccccagattgcaccgccacaaacaccaatcgaaggtttctctccatacatttttcccatttgggacctgtgcataattataattcatcaccataaaaatttcctgttgcataacaacctgactcctgaagtttcgcgcatgtgtacatattgctccatcttcaagtacagtacaggcacagtaaggtgacacgtagtagaacagtcaaactaacacatcaggcccaccatccaccttacacgtacggtacttgtagaaaagcgcttcgttcaattcaggttttaggcatttccttcactacagttcactacgaatggtagctaccatagagcgtgtatccggctgttttctttttacattcacaagccactgatattactgtattacaatagtgaaatgagagcaccccaatagtgaaccaaactcaacttcttcggctagcaattccgcaaccctaaagttaaaggaggcgtcgctcttgtgtccagcagcttcgtgcatgatcatctcgggatgagattttgtgcccgacacacactaagaaactgagttgtagctgcccgtcaacctcaagtcaacaaagtcactaggtacaagtgcgatgaccctggacctgtgaaaattacatgtgatgcgtcctacagtatgtacttgtactctccaacgcccctaaaatccgctgctcatctgcaggagacccaaagaggcaaaatgcaatctattgcgctggatgtacggctggctgggggtacacgcttctttgattttcatttcccacagatgaccgtttttgatgtcatgcgtttcctgcagaggtcaaatttccccagacaaagaagttactattcatatagaagtagacattgctttggaaggcacattggaagcacatgtgcttccactctgttggtcaagcaggattactatctcgcttatgtatgatgatgtaatgctcccacagatatgaaaaattacacgtgtattcatattaattcaagaacagcaacagttgatgattgaacagaccgcagcagtggctactgcgtgcacagtattctggaaacaagcttttttgcattttttcttttctcctcccagtattacttatactcgtgatgtatccggtacaagtacttggacactcattctgtttatataaagattgattgactatgtagttaccgatatactggatattgaagtctttccccttgcattgcagatttaaaaagagctacaagtaattggcccacctaacaccacgacaccaataacaccattgacggcatacagtctgtgaggatcaaggagagtgtatttaatagtatgtagttccactatgctctacgagaaactgaagcacttgcaacagatacaagtatttggacttgtaacatgtttcttataagagacctcgttgctattctccctttcgccacctacttgtgccagtatgagcacttgtcggcggtattatacagcttcaatagacgcaccaagaggtacaatttttattcgtgatcagaatgaggtcgatatcttttttcgcagcgtctgaaacaagctacaatcgactgcaagtacttgtacattactgacagtcctacgtgtatcataggtcctacttgtaggtataatactgaaaacaaagacaaaggaccagacatgagaaacattcatggcggttttgaaactggggtcatgttgtaggttctcttttgtgcggcaattcttgcacaaaagaattacgaacaaacacttctacttgtagtttcaactctcctgagatatccttgcagttcttgtcgcgttgtgagtttgattatgtgagaggttgtaagtaccgccggtataggtagccaattaaggcgggtctgagattttcactcttccgaaggcatagaacttctgcgtcttgcagctcatatcgttatacaatatattcgagaatgatatcacaacgtgtctctttccaccattgactctaacttgtgtagctcgtcaaaaatgacttcttctaatgattaggttgccctttaaaaacagttatagaaaagtggcgtctgaaaatgtgatgatgattggtgatcttgctgtatttggtttattgctttttatggtcgtcaatttcagccctgatacctccctgaactccgacaacctgcaggtcgacaggatgcacgcatgcaccccggccatacttctatagcttgtgtcagatgcatgaggacagaaaaagcggaatgagcatgccgatggatccgcaaattcagtgctgcatgggacatggttggcccaccctcccgctacaagcactggtaccaatagcacaagatggtacatacaagaacatgcgctaggtacaaatacgcgtacctgtagtgtgggagaatctcaggaacaccccattatgcatgtaggagccccccaaaagcagcttggagtttctaactccgtcacggtcccagaaacatggtttctgaggttttcccacctcccctctttctaagctccttttctacccaacacaattaactccgaagtgcacggctcagactccgaagcaatgtcgtgatcaacaatttgctcgattcagggagtttattaattgataaccgactgattgtactgtatgtactagtcatgcaattatccccctaaattgagcccagagtgtgaactgtgacacatttccatcgagggagtttgattttgagaaactcgtcaaactttttttatgcctgaggttcaggtgagcgaggatagctatcactccaatgccaaaagcaaatgtggcagtcaccttgctctctcttccagtagagttgtatggtttttctgctattaattacaatcaggcagacctcagcctgaccgccccaagtttttgggatcttgtgaatcaatgcccaatacttgtacgaagttctggcgagaaaagcctcgtaaatgttcgtgtgtcccatgattcagcaggaggagtttaccatggtgttaaccgagactgtaatgacaattaaccagaccaccgtcaccttaccctctaggctacatatatagaaagctgtagtggtacttgtactacgtagaagtgcctgtgtagataaggtgatgagaacccagcagatatacaaacgccgaacagaggttagaagtatgacaatgcttgaccatttactccaggcacaacaacatcaaatatcgtacaagtgttttttttgggagagaataaatataataaataatatacaggttttgatgttggttaatttcggggaacaggtcgcttgtgctcagacttccagccctgtcgcttgttctgaaaccatatctggaccactcgaggggtcatgttgagctccttggccaagtcaagtctctgctcggaagaaggaaagaatgtctgctcaaagacttcgttgagccgagcaacttggtaagaggttgctctgcgtcgcttgggcttgggggtctgaggaacagcctgaggaacggccgggtatgtagttgtagccggggcagcgtagtagtgggtgctgggcgctggtgccaaatgggtgtgaggaggagccacatggtggtaggcagggtgaggagccatcatatggtgggggacatggtgagggggaggtggaggagggatatggtgatgtgtgtggagaggagcagcatggtatactggcactggagtaggcacagtatgaatgggagagggttgcgagagcgcactggcgtgtggaggagcggcagtcgaggtgtactcatacagaggaggagtggaggcaggggtcataggagaagtaacattcttattcagtcgctccaggggaggagacaactgccgagggggcaagggttccggctcatcacataggagtgatttgactgatggcagtcgtgtatctcgtggcggggtacggaggccagtgttcatgttgtggatggatggcagtgagaacgatggggtggtcgaaggcattgtgagagtaacggacattatttaattgtggatatattcaaggctatcttggggggcttgatagatatatatgttatgagccccgatcccagccaagagactttggttatgcagaatcatgggtgtgtagacatttgggtttcgattctttgtttgagaattgctcccatcgaagacaaagagacaacaaagcaaagttccatacagcaacacataattaaggttgaacgaatcttaacatacacatgcaggcgctgagcttaatggaactaaacgctaccacgatgacctgtgcaacaaaactctgcagttatactcatacctgaaattaggtcaaccctataattccggatcgcgggactttcgagggttaggggattgcatttgaatgattgtggcattgaaacgtgtaaattgtggtgagactcaatccaggttaggggtggagaacgtggaaatagtggattggagccggagattggaagaagttaagggaaacccatggttcagctctgctattagggcaattaaacgttggggtaactattgccgttggacttaactggaacactgtctttgtagctgagtatttcggtcatttcaggcttctggctcttattcatcaggacgaccattaaaactgcaccggcattataaattatcgttctgtgactgaatgtttcgcccgccaataccgcttgatgtgggaaacttttacttctttaggcaaaagaggaagtgcatcactgcagtttgacttttcgattcatagccctacctctcactgtcacacatacaagaacgaagtcaggcttttatatgaattaatttgacacgataaacaaagaggagagttattttattttattttttgggcaaaaaatctctgagtctacccccgcgatcggttattttgagagcggctattaactgtgcgtaagagtgaccatatgcagtgtccaggccacatgatgaggggatagcacgtatatttgcccttctgaattcaaccagatactaatttggtacctgacatgatgtggattgtttattctcctcttctctcataggttatggcgaagtattatggctgaattgcaatgcagtggcgttctgttgacaagttagggcaataccagaaattgggttcttcggctgtcaagccggtgagcttatcgatgcgaaacatggccaattccagaagcagtgggaacttcctcatagaaccttaaatccacttccggttgacatgaaatgtgtgggggaatgtgcgatggagcaatattccctgtatcatcgacaaatacttttgagtggacaatcatttataattcggtattataaagattatcttctttccttaacgatctggtttttaattaatttaccgaaataatatatatccagtatatagtgagtgagtgtactcgtacaagtagatccactttgaaaagatgggactactcggctggccggacactcaaaacaccacctcacaaaggaggcgtgcgtccatgcataaggtgggcatagatatcggacactaaggccccgtgagtctgggcaggggtcaaagaattgccataaaattccaatatagtaagcagtcttctatatgttatggcgggtggaccattctagtcaccagatcaccgtggggccttagttttatgcccatcaatgatatggattttagatcttatggtggttgtaataaacaacacttgcataaccataaacgccagttagtcccagcccctggcattggcgttgtggctaatgacaaaggcaatagcagttgctcccaaaatgaataaaaggagcactgaaggcagccacctgaacaacgagtaagatcaaagccataacatgagcacatttaagaaaagaccctttagactccagatgattcacaaaaatacaccaccgccacaaaacctggagtgtactggtaataactgattaccacgcatcgagctctgtgcaaacacaaacagctcagccacattgtcttgagtattgtggcaaaactgaatcttattaaaacacgaaaatgcaagtataaccgacaaccctatgtattattacagaaacagaaataggtgtaatacccaccgcataatccaagatgccgaggtgcgttgattattaatgcgtgcggtgtggttgacatatcctctaaccatcttgctctgccgtcatgtttatgtatagtgggctgatgtcacaacgagtcgaagtacagtacactgtattttgctcgtgacttcattaaagcttatataaacgacaccagggacactgtcgcatcttacttgtagcgggtacttgtacgatacaaggtcatcctcgtgcggtgccggtatctgtagttgcacttgtgggacagctacaagtagttcgatcagtggtgttatgacgcaaaaagacaacttcgtcccccatctgaaattataaattctgaggcttaacttgttcttggcacctggctctctttctttgaaccatcttggctggacggacagtgttctctccgctattttcctcgagtttgtcacttgttttcgcagccttcctgcaaccctaacattgacgaggtcacaaattttagatgtgatgtggtcggggactacagtatactgatactcttatgatgggttttgttctcggaccagcgtttgtctacgcacataaagtgccacgcaggtcccgatacaatagctacaagtagggctgaggagaccatcgggaataagatccgaagaaaatgcggaataggccggaaacagcaaaaaaaaatatttattttttttaaaaaaaaagtcgcttaatgaatcagtggggtgattgttggatcacacacatatctacataatccaagtggaaccacgcggtttgacagcaattggggctgcttcccacagcaggtattatgctgccaactcccactctccgtgttcacaccctgtcgcttgtcatctccctcgtacaaggacaagtgcaagtatgcggctgatacatcactgtgggatatggcataccatcggctgggcttcaggagatttttgcctaaaacgattattcctatacaatctaaaagtacctgtgctatgatgcttccattaaactataatcttaattatataccctcatcacactaaactgaagggtctccacaggacaatttactgtattcaaacgattctctttgagataaacgcccagtgtctttattgttcaagctaccaaccgtatgtaatcaatgataaaaaaaaagtgaggctcactttgaaaactatccacattgttgtgttggactccaaacgcctttgttccattactatataagattatcaaaataatcaaaataagattcactattaagcaatattaaagtgtgatgtataagagcaaaaaaacgcacgcacgccgtgcacgattgtcccttcgaatagccgcgaggaatgtgtacttgtctgtgctcacagctagacaagcaacgaagccggagccaagtcggagatattgtcttaatgcataacttccatcgccgaagacaaggggagctcttatgaagcttgaataacatgaaaacctcaaaggtgaaccaactgtgggagcgggcacacgacacttacgtggttatcaatatgactgggtcatcgtaattaaggtttatacaggcaaatcgtgggttgtttttttctttttttcggcccggtctcggcaaatgacaagactatgtctgtgacaaaataagaagcccttgttggtcacagaaggtcttgaatctatatagtttttttcgccgtcttccctgtgttgttcttctagcttgtagagcccattttaaaaaataacacgtgactttccccgacagaatattcttctcgggatatcatccgcattacagctgcatatgcaagacagccaaggacgtatacgatgacggctgggtcagatggttcgtgacaaagtttggcaaatgaaatgcaaacagtgatagcaagaagaaagttgagtttaataaacagcaaaaaccaaaagtagctttgagcaccaaactaacagtgatctcagaactgaatttcactctcgtcggctcttctctcggatgttctaatacgcctagcatgcggtgggatcgaagacagagcaactttaccgtatatttgcagctgtggatgcggaggtataagccgtgagctattattcgggatttctcatctcaggtcgtgctgctctaaataccctggaccaccccccattgatccataattttgtgaaaagtggtccagaggaggaggggctgttgtatagcgttggggacggacacagttgactgtatggcatggcgttatatatacaagtgccgtgtaaagtatttgctgaggctgttccgattcaaccacctactgaacagcagctgtgaagcaagagggaatgactacagtgcctatcacttcagtgcgagtacagatgaaacaatttgttgccacctgtactcacttagcactgtagcatgggattatcagagtagtttccgatgcttggtgacttgccaaactgtgcccatccgaagagtcgaagacctatggccgattctgattgaggttggcaacctcgggcaactatccactcttcctgtaaagttgccacggccgcagctttttctaaatccaagacattaaattaatattgcaccgtgcaaaaatttcatttccccctttccccttggacatgacgttgggctgcaggtctctgcttcaggctgcatatcgccacataaacggagcgttggaaatgaaaaaggacagcatggctaaaaaaagaccaacggggttcatcttaaatgttgcatgtgcgtggtgtcataaatgacgcatttgccgttgttttcagtcggtcgacaggagtccttcatcttcggaggtggtcgaaagtggctataaactcgcttgcatgcaaccggagctgccgatggttccgaaatcggcacggcacaaaagcaaaaacgccgagactgaacagcaggagccctcaacaagacatctcctccatctacttttagtggatttgaatacatacagtatctggaactctggttccaaggaccagtaccagaatggcaccattcgagcacaaaggctgcgagacattgtaccatataagcaggcttttagacgcagcagacccatccgagcagactgccttgcagccgggcaatctcgggaaatcgacaatgaaaccccaattcacgaaataggatttatatcaggtgaccatctgtcctaattatattgaagagatgctaggaaaaaattggagccctcttacccctggcgctagatagattctgctgttcgccctttttgtcagactacaatactttcatgtcttatgtaccatttttggcccagcttcagacccgtcataccgctacagtatttggtgtgttgcatacaccatatcgatccgcagtacaagtacgagtatcgggtaccaccagaattaacggtacaaatatgaatagcactgtaaccccacaagactctacagctcagattcttcacccccaccccctgctttcttcttcattacagacagttgcaaagaatccaacgcgcagttttggagcaaaatcaactatggaagcacacttgggacatgcgccaagaaatggactacaaaatactacaagtagtactaacgtcacaagttttctattggaacgagctgtatcaaagatttgagcagcggccaaagccctgttctgtccgcttccttgtgtttttaggggttttctttttaacggagtcagcaccctggaattagtttgaaaccagctttactacttgtagttacactacttgtaggtgcagatgtcattaataatcgccatttcccatgaaaactaccctatgctgatggatagactaaccagacacgaggtctgaacacaatcgggtgtgtaacaagaaaaaacacctcaagcagtacatccatgacgactactgtttctcaagttgagggtacatacaaggactgtgcacaatatatcgcacatgtctcactttcgacaggaagtatgaactccggtggccagcagcagtggtgtcgtagcagccttgccagcccgcttcaacattctacttttttagcttaagctcgattttctcgcttaaaattgtcgtctacggattgattgtgggctgctgcaaactgctgcggggttgatccgtacctggatcgaccttcggtcgtttaacgcgaggctgtcgcaagcggctgtggaggattctaagtgcccttcctgctgagccgtcagaagagcttggagtgctacgggtggcctggggagcagggttttgattaacttgcttacatattgctatcggcgcgacgtgagtgtctcggaggaagtatggttttcgaatgaggcaaggtactctcgtacattgtagaagcacggtatgagtgttgataaagcgactttgcattttaaacaataaccccgatgctgaaatcaaaaagtgccggtacactacactacacacgacttccatgtagccttacaggtaccgcaccgtaatgggggtactttaccaatgccgatacttgtagtcttacaggtacagtacatactgtaccctaccgtacatgccgttatcggtctggtgtgtactacagtttgtatacagtatgtatgtacatgcttgtaagaaatacctctgaataggtgactgacgatacatacatacatacctgacccgagtcttactgtcgcttgctcggggaaggccctggagtggtgcggctgctctttccacgactttgattcagacgttagaaagccccggattcttgtcactgaggagtagtacagtagcgcgtcgttgccccgaaactccagcctgtaaataagctcagacacaagtcggcatgaatacacgcgatgatgtaattaccctatattaaaggcaacacaatataccctacaagcagcatgtctcagctgtgtttgcattgttttaaaaaatatataaaaaattaaaaaattagaactgctgctgtggaactccttccaaaagatgtccagtctgggcaggttttttttacatccgttcgaacttgtacttgtatagagaactcatctatagagttattacatgttatattgtgtaagcggaaatggcggactttctaatagacactcttgttgcacctatccgacgcaagccgtgtctgcatttatgattttcttgctctataatatgttatacgtgtcgcggaagtattgtacctccagggataatggcatgacgacggacgaacgaacggctctcggttttggacgggggggtctccaaaaacatattgcatattcgcgatataaaaacaatagcagaatcaccgtgtgggtgagaatgacattggatacaatcaccgcgcgttcaatattacggtacatactgtacatatcgaacgtcattgattctcggctggttttttccctggaaaaagcaccaggcaacgatatacaacatagaggttcatcattattgatgtcgttcgtgtacaggaaaagaaaccccaagcgagctcgtgtgatggaatgtcttcccatatggaaaccttccgtctgaaatatagatatcaaactattttttagatgactgtgtatatacattgagttgtcatttaatcttgtctgaccggcatggaagggcctccccgagcgagctttctcgccttgtcgttcgagttgatgcgttttggcgacagcttctcttccgttttctgtttcccgtcgttgtttggcttcatgagtgttgggtcaaaccgacggacttcggccaactccggggtgagcggttcgataattctgtaggattggagcgccttattgattgtatccatgggatctggtttgaaaagactctttttgttcctccaatcgccagcgacgtatttgatcatttctgccatgccgcttctaatgtacgactcggattcaggtaccttgcgaacacggaatacgtagactccatcgcacgcacctggggttttgtggaactcttccaagaaaattcttctgtatatcttggccgtgatgcttcggtagacacctgacgttaatggacaggggtttctctgatctttcaagggcatccctgtagatgttggcattcctggagccgcataccccatgttgttgaattcgttgaccttgtgaccatttaggggtaggaacgaatgccactgtatgacaattgacggtctcgtctttctgaacacaccctgtaccgtccatggcgacaagtagaacgatgtaaaatcgactatgctatgggagtaactggctttcttgatgccgtttccaaccgtatgctgatgaattcctttgagctgagtgggatctgtgaccacgtccggccaatatgtccccgggtcctggtttccactgttgtctgggggcattatccactttgtgtacttcttcgggctccacatgtcttctgcggtgaggttatggcccgcgacattggcgaagaatgcgtcagcctggaccgatccacacgatctgatttctttgtcgattcttgggtgacttaggggctcatcgataatctcatggtggctgttggcatgtgctgtagacccccggcccgtggcatttttcttgctgaaaagagatctacctactcgccgaggctttcctgttggagctttcactgtctgcgttgacgtggcggttgcaaacccccggatcagctgtctcatgatattggagtgctcaggtggccaaaaaagtgtgctcttgtcatgcattatctcagttaaatttacggaacaaggtttggcgtgcccattctgtactgcatgctgatgagatgaaccaagggtacacacagtacatactgaactggtgctggtactacttttgtcggttgagatggcaccggagcagtttgaggcggtccctttgatgctggcgtgcccgtgttttgcatatattcatgagcttttcttatcgggggttacttgaccagagcgtacttgtacgtgtacttgtagggtatgcaaatccaaattaatagtcacaatttgccaatacttttacgatacttatactgagtgaggtcatatggccgagaaacgaccatcaaagagacaccaagaaacagatgacaacagctcaagacaaacccgagaatgcagtaattagcatctccggagccgatttccctagaaatcaccactacgtcgcgtctatcgttgtgctcttctcacaccaatgcgcgtgcagcaggcataatatatagtatcttcatgagcggaaaaaaatcggctggccagtatagatggactgccccgctgacggcatatagtacgatgaggaggtcgcagacaaaaaaaagtatatggctcacggtgaatagtaaaggtttagcacccttcgcgtattctcggaaaaccgtgaaggatgatgggtgtcaactctgggcttacaaggtggcacgtgacatgcgcagttatgccgtcgtagtttacattcatgggtagcagtaatgagagagagagataagcgatggtctccaactctaggaggtccgcgtccccgctctcagttgccttacttagattcatcagagcccttatcatgattgaagcgcgcattcctcgctgtgcaccatcatcgctcaataaccttcctagcaaacataccgcgaactctatctctccacgaaacctccatcaccaacatcacatcgaacacagaacactgcggcgaaactccacctgccgcccaaggcactcaacaaacatagataaaaaagcaggaatgacgacgccggcgcaccacggcagctcattcgcccctgcacctggggtatctcgccattcccagtcttctcattcgtcgactgcttcctccaagagtcactccggtttccaatcctcttcttccatgcaagcaagccaggccaagggactcccgcctactcccactacaacaacaccaccaacgtcgtttcccacagtcaacggcaaccgtagagtatgggtgtgtcgtccaggagcgactcccaccacggtgttggttcctgcagaactcattgtcgacgacctgaagagcgtggtgctagctaagttcccaacatcactgcagcggacaaccgaccctgctgatctagctatccgtctgccgcagtcagctcaaccacccccatcgcgactgtcgaattctcatctagcgccacctgcgtccccggcactggcagcagcagcagcagcaacggaagagtatcgctcggcgacatcaccacacctcacatctttcacacaggcgctgcgtaagaaacagcctgccaaacctagtcctttgactattaagacaccgtcccagtcagcatcaacagctgcagtgcctcagccgcaccctctcggtgacccattatcacctgatatcaatgtgtggcagctcttggatacacatttcccgcacggaatgcgcatggatgatgccctcataatcgacggagaaacggtcgaggcggcgcagcccgttcatgctcccttgcaccaccatgctgcctcacctcacccccatcaccagccatcgcacattgtgaagcaggtcatcactccgcatgccatccctcagcagcctcatctgcagacccctggccaagatgcattcccgggacccccttcagccacagacgaggaaaccatatacgacgaggacacaaagccagcacggaagcgtcgcgacattggttctgctggttcgtcgcaacactcggtggcaggcgctgcgggtgcttcgtctggttccccgtcccagtcacccgcagccgcaggtacggctcaaggtggtgttcttttgctcccccgacagttccgaggtggcacccgaaacagtgacaaggagcccagtgcagcgcgtaagaagggctcttcgcctgcacccgacgacaagcgaagacaggcgccacctcaaccacaacaccagcagcagtcacaacagcaaccaccgcaacagccagcagcccagccaccgcagcccaagccggtgcctcaacaggcagttgctgcgtcacaagcacaccaatcaaagcaacccgcccaacaggcagcatctgaccccccacccaaacccacaatcagcatcacagctcgacccaatggagctaccatcaccgagtcgcccagcaataccaatctgcatatgctgggtaagcaaaagaaggaagagcccactgtaccagcaccaccaacacctgcaacagcaacggcggcaactgtggccggacccactggtaagacgcttcgcaaggaggataccaaggtacccgcaccacaaaagacacctcaaccaggtgttcaggcccaggcgaaacccgaactgagacgcactcgaacaccactttcagccaaggttcaaaaggggcccacaacaatggagactatcgttccccgtgttaatgtcctgattgtcgaagacaacgagattaaccagaagattttggaagcattcatgcgtaagcgaaagattcggtcgtctgtggccaagaacggtcgcgaagctctggaaaagtggagacagggaggatatcatttgattctcatggatattcagcttcctgtcatgagtggtattctggtgaccaaggagattcgtcgattggagcaccagaacaagatcggtgttttcagcggtggtgctggagctgggcaatccacgatggcgcccgtggaccccgaagatgtcctcgacagcaacctgttccgttctcctgtcatcattgtggcacttaccgcttcgagcctgaaggaggacaagtctgaagctctcgcagccggctgcaatgatttcttgacaaagcccgtcaacatggtttggctggagcgaaagatcatggaatggggctgcatgcaagcactgattgatttcgagggctggaaaatgtggagaggccgtgactttgatggagcgcatgcacctgcgattggccgagcccttgccaacactcatctcactcagccagtttctgcgaccagatcaagatcgaggagcaactcgaggctcgtccgacaaaactctactggcacaggttctcgaagcaagctatccatgacaccagttgcgtcgccttctacagcggcaccaccatcttcgtctgtttcagctccacctgctgttacagcagcaacgcattctcccgctgtccctagcaagaacggagagcgacctcctgtgagtaacaaaccagcaccggaacaattccgtttggatcctccaaaggtggaggttcccgcaaagtagcattaataataagaacgttccgtatgagtaactcgactcgcttgtactgtataaaataataaaaatgcatatagtccatctgttattatcatgtactgtcattagtggtgaagcttgatctgcacctcttatgcaagtaccaagttcaccaccttcgttacgccacatcccatggatcagctcttcaatgtgttcaagtcggttaatacacttgcaacctttatgaggtgtcgaaaacacgttcttccgacagtcaagaacctcaaatgtgctcacaaagacattaccgacgcgcacttcgccatgttcaaataccttcttcctgacgacatctcctatgtgtgggtcgattcacagcaatacagcggcgatcagagggatgtctttgacattgaggaagatggcgacaactggattctcatgttcgacttcatcgatggtgatctgaaaccccagccagccagcaagaaacgcaaagtcgaagagaaggagtggattgcagtggaagatcgagtcaaggtggagttggatgagacggttttgaatcttaccaatccacgagagaacaataaacgtgacaagcaaacctggaatttcagtgtagaagacatgggcaagctggccgccaagcggaatgccaagttcaaggacgcggtggaatttttgagatcaaaaatgaaatccttagattaccaagggaccgaggtggagtacttgagggaaaagattgagattccacaaataccgacatttgtggatgttatgaatgtggatcggaagaaagccacaaaccaaggacaggcaatggtggatgtcactcaactcatcactgatatcacaacgaaggagtcctactctgggcagattgtcgataatggatatatgatcattccagaagaggaagccagatatggcgagctggagtatgagccgaacaaggaagtcatggcagcatttgagttgaccaagggggtcaccaagttgttcacccaccaagctgatgcactgaatgccctatatcgtggacaaaatgtggttgtgtgtacacccacttcttcgggaaagtcactaatttaccagacgcctgttctagagtcgcttctaaacaatgattcatccagggccttgtttatctttccaactaaggcgctggcacaggaccagaagagatcgctgacagagctttccctggcccttgggcttgactatggaacagtcgaaacctttgatggagataccccctttgagaaacgatgcgaaattagagaccgggctcgtgtcgtcttcacaaatccagatatgatgcatgtcagcattctgccaaaactagatgcagatagatcttcctggaggcagttcatccaaaacctgagatatgtcgtggtggatgaaatccactattacaactccctatttggcacacacgtgagtcttattctgagacggctaaggcgcgtgtgcaagttactggggaataacgtggtacagttcatttcctgcagcgctaccatcaacagccctctcactcacatgagtaatttgtttggcctagacgagggatccatcactttggtcgattcacctggcggagcgcacggtctcaaacatttcttagcctggaacaccccttacatatcgcccacagatccccgaagcggccgcgtatctgtggtcggtgaagccatctctcttctggcacacatggtgaaagagaacgtacgtaccattgttttctgcagagtcagggttatttgcgagcaaattatcaaaggtgttcgtcaaaagtttgtggatgaaggcagacccgatctgtctaacttggttatgagttaccgcggcggctattctccacaagaccgccgcaaaatcgagcaggacatgtttgctggttgtttagtgggtatagttgctactaacgccctggagctgggaattgatattggacagctggacgtatgtatcgttgccggatttcccatgactgtgtctaatctacgacaacagagtggccgtgctggacgacgaaaggacggatcagacagtttgactattgtcattggttctggagatcccgtggaccaattctacatgaaaaaccctgacaaaatgcttaccgagcctacagaagcccttacaatcgagcctcttactaacctattactcctcgaaagtcatattcaatgtgcagcttcggagttccccattgagctgacacatgatgtggaatttttcggtcctttattgcatacagtgaaggacaaactaattgaagacaagactgacgagacaaccttctatcacacatcatcacggttctctgacaatcctgctaaggatgtttccattagaggcattgaggagaaccactatgctgtagtggatatcacccacaacaagggtcacatcattgagcttctggaagagagcagagtgccattttcgttatacgagggaggaatctttatgcaccaagggtttccctaccttgttgttgatgtctcagtggaagaacgaatgggtaaggtccgaagggtcaatgtggactggtatacgagacagcgagacttcacagatgtggatccagtccagtcagaggaggtgaaacagctttcgtatggaaatgggggcggaaaggtgtcatttggaaacatccgcatcacaacgactgtctttggcttcttcaagcttgacaagcgagatcgaatcctggaggctgtggaggttgaccatccgtcgtttgtgataaacacaaaggggttctggattgatattccacaatccactatgaaactgatcgaggccaagaagctctctctggccggtgcaattcacgccgccgaacatgctctcatcaacttctttccaagatatgttgtctgtggaccaggagatgtacgcacagagtgtaaagctcctgaaaaggagtttgctaaacggcaatccactcgaagacggccttcacggttgatatttggagacaaggtaggcggcgagggcggctctggcttgtcacagaaggcttttcagtttgtggaagagatcgtcaacaacgctgtcgatggagttaacgactgtgaatgcgactggggttgtcactcatgtgttgctggggccttttgcacggagaatggccttgtgttaagtaaaccaggggcacagatcattctatccaagctcgtcggtagggatattgactggactaaggtgaaggagggtcctgagccgaacatgcctatagcagagactatcacaatcgaatagacattcgacaagtcaacacaataaaatataaaatctattgtaaatattacatatgggggtactgtactgtacattactgtacttgtacatacaaatgttaccacaacaagttctgggtattttgagagccctgagcaataccgttctgtgtaacgaagtagccttggctgccacttccgtcatccagcagctgctgtgattgatggtgcacagcaacgctgttagatcgctggggcatttgcgggaagctgggggtagtaggagtacctgtggtaggggtggggatcagcggagtgtactgggccagagatgggctctgaagagtgcccagattcaatgatgcaatgtctggcatgctaggagcaggctgctttgacttttcagcctgctcagcaagctgtttaagttcatccacatcgctgtcttttcgaggaatgagacacggcgatggagtgagctttctgggtttggccagtcggaatacatggcgaacaggcttgagatagatagaagcgagtgtaccgatgccaagctccaactcttccagaactcgagggtccatgattgcttcatcctcaacatggatcagaggcattttatcgggatgcacaatgtctctggcagcagaggggtcagacgacaagagacgccagtacatgtatcctcggtctcgcaggtcggggttgtcagtctcctcagtagcccacttgagcaccttgggaaccatcgcctggcctctggtaggtcgcaggatgaaaagtttgacggtggccgtcaaaagtgcaagctgaacgttgacgggctcatcgtgccacgtagaaaggaaatgttgctccagaatgagatgcgagtcatcaattcggtcagcgtactgaccgacaatccagaccatggcctcacgggcctccggctcatcgagagcatccaggtgctcacacagctcaccaatgacgccctcgaaccgaccggggtatcgtcgaaggatgttcttgagagctacaatggcttcttgcacaatatatgacacccgggtctccacaaggtacatgagtgtgtcgacactggcctttgcggctgtagcagactccaatttgagggccagctttccaatggctcgtacagactttcgaaccacctgcacgtcgatttccgtcgcgtactcacgcagctcacgcagcacaactccaatgttgctgtcgttggccagcaaatagataagctccagcttagtggtcttgatatagatggggtcgttgtacttgcagaagaaagccttaacagacaggccctggagcagctggggttttgattggaggataaggatgcagtttcggagcgcaaggtactgcaactcaggctgcctcgaaatgaggttgaccattgcggaactcagcttggtggggatctggggcacgtgttccaggaggttctgcgaataattggcgaggtagacaatgagacgcacagttccgagaaccacagcagcattagagtgctgcaaccgcggaagaacacgctccaccatacgctccgcttccagagctgtctgtggggtccagcatagtagcgcctggagcatgctgatctgcgaccattcggaacactccccaagcacggtagcaatcttggacgcgtggttgtgatcgagtgtgagctgcaaatcactagacttttcggtgatgtccatcagggcagccagtgctgaggccaccacagtggggtttccatcgttcagcagcttgttgagcagtgcgatcaagtcagagtgctcaacaatcttggtgtcatgggaccacattttagccacggccagacacgcagtcttgcgaacataggggtcctcatcaaacaacagtcgcttggtaggctccactccctccctgatgaagtcctccagaggaatagaggaaagtgttttgagggccagggcccgaatcaagggcgactcccgggatccagcatcgtccagaagagggtccagcgctcccgtggccagctcaggtttagccttgcagtatgtgatgagatagaggaaacacatcttcttcacgtccagatcgttggacgatcggatcatgtcgataatgtcctcgaataagacaatcatctcattgttgctcatggtcatgttggccacgatcttcttcagcaccgccttcttctttccgacatttttcggacctttggctgcctgcagctccgttctcaattccgcagcttttccctgagttagcataacctccaagacgcgcccgcaaagcgcgaccaccccaaatactcaccttggtgaagaatttcaagtcactcatcttgtcgtgtacaagaacaatttacgtgttccgactgttagtgcatatgcaatatcgcgcagcccattatgtaaggggggagaccatgcaaagctaatatggcgatgctgagatgggtaccggaattcggcctgaattattgctaaatactggaaaatatatcaaaaaatcgaattaaactacaaacgactgatgaagcagattcggacgtgctcagattatgccagatcatgccatgacacgtcacctcactctacagttttgtaggtatccgaataacaccaataatatatatataattcatcaataaaaactcattccaatccaatcctacatcagcctaagtatcgggatacgatctcaaatccatagtaagaatcttggacgagttcacctcctgatctcggtagataccaactaaacactctccatgagtgtacagaccccgcttgagagaaatcacaatgaactgacacttgctgccagcatgcttccgaatgtagttggcgactcgttgcacgttggcattatccagagcagcatcaatctcatcaagcacaaagaagggcgacgggtggaaagagtggatggagaaaagtagggccaaagcagccatagtcttctctcctccagagagaagctccatttctcgaaatcgtttcatggggggcatggcgtggtacttgattccctcaaggtaaggctcatgctcatcttcgacagtcagagtagccgaacctcccagaggaaacgcatcagaacgagtgagctccttgtacgtagcgtcaatgactccggaaatgtgctcgaaggcagcattgaacttatcgcatcgagcgtctcgcacctctctgaattgggcctgcagctcctggagtgcctcacgttctctcttggactcagcttcgatgctagcaccctcggcctccacttgctcgagtcgagacacggccttcaggttggggttgattcgctccagttcagcctgcagagccttgatcttggaaacaagagtagaatcgtcggcaagtcttcgaatgccctggggaagcgacgagaagtcaacctcaatatcgatatccatttgcgagtcgtctccctcaaccagaggcacagactcgagatcacctgacaccagaggaagctcaatgccctcaatcttgcactctcgcagaacctcgtaccgctgagtagcagcagtctcaagctcggtctcagactgggcaagctttcgtcgcaggttatcgaccacgccctgagctcgggaaagatgctccttggcagcgttggactcagttgacgcgttctgaacggcagctgtgagcttctgaacctgctttgcctcagctcgagccttttcttccagaataccaatgtcctctctcagctgggcctcatcggcctcccagccatccacagctgccttgtcatcatcgatagactgtcgaatcttggccagtcgccccttgcactcgtccacacgcttggagccaaacttgagctgtgactcgagagtagcaatctgctgagagaatgcgagccgctttcgctcggcaccagcggagagagagccatgggtctgttcatatgcaaacacgtcctcaacagtcacgccgacacgagtgcaataagacgagaacacggtgtaccagacttcgtcaaggcgttgttgaatggtggccttctgtgtctcgagcttttcgagatcactggcggtgctggcaatctgcttcttgctcttggcagcctcctcgctgtagtacttgagctgcgaattgatatccttgagacggtccttcaggctggcaacatgcttctgggcagcagacacttcctgtcgcaccttgtcaacctcacgctgcagtgtatcctgacgctcggggtcaaacttttgccgaccaacagtctgtagctccaaaaccagagcatccttctctgcctggagctttgtaacctcagactcgtcccatttggatgctcgcttgccgccatggtggcccttctgggtagtaccaccagtcataagaccagccttgtgaatcacggagccatcggtggtcacagccttgacattcaggctccatccaaggcgtttagcctccttaaggtcgtcacacacaatggccgagccacaaacgtactggaaagcccgttcgtactgagacgaaaaggaaatggcatcaatggcaagtacagccccacgaagacgcgaccgcaacgacgagttgacaggcatggccttgatagtatcgaggggaatgaacgaggcaagaccgccctgctgctccttgaggtatgcaatacagtcctgtgcagttttgaaactgtccacaacaatggaatcaatgtccttaccgagaatggtctccacagcaagatcgtgtcgcttctccttgggcttgcacaggtcgtagacgagaccgtggaccttctgtgccgagaaaacatgcttcaggttggcaacagtctctttaagtcgtcgttctcgctcagtctgtcgcttgaccgcatttagctcaatcagacggttagccacaacacccagcttgtcgccaagctccagctcgacacgtcgtcgggtagtctgttcgtccacaacccgagccagagactcactctgagttctcagagcagactggtgggtcttgagtacctcctcagcttccttcagttgggtctggtagacgccaaactcgcttttaaactccttgaccttgagttccgagtcctcctgtgcctgctccagagctcgcttatggtccagaacaggtctgagttttcgcttcaccgtctcaatctcagcctgctcagccagcgaccgcttgtgcacctcatttttcagcgtgctatactcggccgcgtcctcatcagttcgaataactccgcctgactccttctgcttcgatgacagatctcgttcaaactcactggaggcatcctgaaccatcttgagagagcctcgagtctgcttgacttcgtcctggtgtcgaagtaagtcagcctcgacagtgccgtaccgagcctcgtgacgcgaaatgttgccggacaccacagcaatacgttcagccacaggcacgagctgctgcttgtgctccagaatgacgtctgctcgcttctttgccgaacgctcctgcttgagcagccgcttcttgtcgctggcatatttggcagccacgttttccacctcctgagcagcctcctgaacagccccctcggcgttctggatagcagcgtctccaccttcaatctggtctcgggcctcatcttcgattttttgggcctgccacagtctccacagctgctgcttcacaacggcctcgtctcgctctgcggccttggcggtgtacgcgtcgtaacggtccttgagctcaacgtagtgcttcttctcagcgttgtaggtacgtcgtcgctgccaggctgcgttgcttcgctcagtctggacatctagctcctccttgagacggtcgtattcgggcttgagatcgatggagccagaggtgatttcaatcagcttggacaagtcttgaggcgactgactggcaatctgctccacatctccctggaagaccaggaaatttcgggccttgaccagaatgttttccttcttcatggtggcattgtattcgcctgacgacgtgaccttgttgttgattcggtactcagacgtgcccgagggtgtgatggttcgcttgagcttgagtaggtctccatttgacttttcgtactccaccagaacgtatgccgacgtggcttcctgagactgggtcgagctgacttcctcgccacgcatgattcggcctcggtagatgaggtccttgagctgggtggatcggagctgcgaagaccgcactccgagcacaaacgagatggcgtccatcatgttggacttacccgaaccgttggggccgatgatggccgagaacgacgagtcaccgagatccacacggtgcgtatcacggtacgacttgaagttgcacagctcaatagccttgagggtgcccatagtgttgtgatggtgttgtgatggtgtgtggtgatgttgtgttgaagtgtacgcgtgttggtggtagaatgacaatttacatttcactcgcgtccatctaaactttattttggaataaaaatacagtaaaagaaataaaagaaataaaagaaataaaagaaataaaagaaataaaagaaataaaagaaataaaagaaataaaaaaaataaaagaaaagaaaagaaatactttgtaaattacgaagaaaacaaaaatataactcaagtacaagtacttgctggtttctcgttatagacattgcgaaccacacgcacgataattcagagctccacgcgaattcagctccacacgattcagaagctatcaaaccaaacctcaacggactggtactatctgtagaacatcaatgataacgactgttgttgtcgtcaaaactggttgctccggtcgagctgctgtggatcgatactgtctggacaagactattactacaagcctataccactgatcttcagttgaaaacaactcaatgcggggtgatggcgaataccgattggaattgggacaggaaaatcagttatctccaagctcgaggggaaatatcgtatctttttgtgtttttttcagacgtattcaagtctcaatcttccaaatactgtatgcatcgctcgtccagtagcctgcctaaagtttttgatgcgaacgcgtaaacaataaaagatgcgcatgtatgatactgtttagggggtagtctagacgacgctaccatggacctcgaaatggttggaccagtacagaaattgaaggaaaagaaggagcagaggctcagaatatggcagtaaagaggatatccactgaccccccctccatgttcctgtttctctaaattttgccaccgccactccgcgacaaggttcgcttcttaccctacttaattaagagtgtgcacgcctgcgcgacgcgttctttccaaaattcatctgcttgttttctacgctccacagcaacacacacacacatacacacaagaccacaagatacaagatgacgtttgagctatcgaccggatttttcgacgccgtggagaacgccaccagccgagatgagctgcctgaaaagtttcgggctccaattctccagattgtgcggcccatgagcgagctgcccggcaagaacagattcaaggtgactctgtttgacggagaaaagcccggcatggtgttcggcgacctggacaacctgccccaagaacgaccgggcaaattcgacattgtcaagctcagcaactttgagctggtcatggccaaacagcgaggagtcgtctacgtccaccagatggacttcttgagccacgccgacgcggctctgggactcgataccgaagaggatgctgagcttcctggtggcgctgctgctactgctcctgctgctgccaccagcaaccccacccctgccaagcgaatggcttctaccaacgagattcctgctggtgtccaggcccagggattccccgccactgtgatgcccattgagcgactttcgccttaccagaacaagtgggccatcaaggtccgagtcacttccaaggccgacaagaagaagttctccaacaccaagggagagggccagctcttcaatgtcacctttatcgacgagacgggcgaaattcgagccaccggcttcaaccaggaggtggataagttctaccccatgctggaggagggccaggtttactacgtgactcaatgccgagtctccatggctaacaagaagttctccaacgtgaacaatgactacgagctggtgtttggccgagacacggttatcatccaggcggacgaggccgaggccgctgctatccccacagccaattactcgtttgtgactctcgataagctgcaggatgttgaagttggcaacaatgttgacgttcttggtgtcgtccagaacgttggtcccctggaagacggcgtggccaaggctactggcaacccctataagcgacgaaacctcatgttgggagacaagagtggatttgccacccgtctgactttctttggagagaaggccacttccttcgacgagggaactgttcctgttggcaccattatcgccatcaagggcgcccgcgttggcgactttaacggccgaaacctgtccaccagtcacagctccactattgccgtggaaccagccatcgacgagacctacgcgctcaagggatggtatgcctctgagggtaagcagacgagctttaagcagctgcagacaactaccaccaacaagcctgtggccgccacacccattgatgtcgccacatccagctacggacagtcagaaaagcccgactactacaccctacaggcttgggtcgtgcacgttcgaaccggcaactttgcataccctgcttgtcagactccggactgtaacaaaaaggtggtcgagcatggtgacgagtggcgatgcgaaaagtgtgaaaagaacatggataaacctctttacagatacatcctctccatcaacgtgggagatgccacaggaagcatgtggctgacggcattcaacgagcctgctgaagtgattatgggcatgaccgcagatcaattgaccgagatccagactagccaaggagacgatgagtttgagcaagctgttcagaaggtcaccggcaaacagtacactctgcgatgccgatccaagcaggagttttacaacgaagaatccaaggctcgtcaccaggttcttacggcgcaggcgctcgactatctcaaggatattgatgagctcatcaaggacctcgaccaatacatgtaatgggggattggtgttactagttgttatgaatgatgggggtatatatagtttatgaaagattgtaatttagcgcaagcaagtagttctgtcgtgagttcatcattcatcattatctataatcagttcttgtggcaaacactgtcgttggctacctgttagtaatccgcttccacacgttcaacgctacagcatccacagcaccgagattaggagctgcaacactctgctgcaccttgaacagcttggtgtgggttcggttccatacacccactgcagcggcacccgtactgtaccctgtgcccacagtgtcagctagggaggtcacttgacgacccacgcgagcctcatgggtgtagagactggtccaaatgagagatagataccagccaagaagcactgggtcccactgaaactcaatcttgtggaactttgtgggctgcacaggaggattgagggtgcctatagtgtcgatcatcgtggagggtgtgtctttagtggtcttgggctcgtcgctagcagggcttgtgctggagcttggtggtggtactgcggagtatgtgttcaacccagggacagaggactcaatcatggcgtagaccgtgtcaatggtgtcgagtggaaggtcttctagccatgacaagtcctcctcaccatttgtaggctcctttcctttctccttcacgaggcgatgcagcttttcaaatgacgaccgtcgcttctgtagaacaaagacaagcgacttgttggcctgaaagttgtattcaagcatggcgttgatggactccagggtgagctccaacaggaagcggtttgtggagttggcgaacaagaaggagggcgatgacagaacgtcgaaaatgtcaaccagctggcacgacaccgtgtagtcgatatgcttggcctgcacagacaggttgtagatgcattcaaccagagtggggatgatggggttgatttcttcacgaggttgagtgatgacagagaagagctggccaagcacatagttgaaattcacagtgccatcgtcgaacgaagacacaaccacatcatcatcactcagatagagcaggaagttactgagcagcctcagagtctgcgtgctctcacacattttgatttgttgcagaatcgatagaatgatgttgtcgaggtaccccttctttagaagccacggcaagaatcgcttgttggtctgaatgatctcccataacaaacagataatctcgttggtgcgtgtttccttcttgccagtcaaaatggagccagaggaggccgagaacttggccagaatctcgctaatgtgtcttgcaatgaactcaaagtccacatcctgcttgagtttgcccagaaagtatctgaagttgttcttcacgcccggctccggggggtagtagacaacaagcagaagcaacagttccagggcccagaacgccgtctgagagcccccaaacacgactgtttggaaggcattggcatcgcgcaacaaccgcaccagcgacaagttgagcagagagcacagtagcaacagggtgtcgctcttaccaagcccgctgacaatgcacgtgagaaaccgggagccctgcgtggtaacatggttaacactagtgtacagctgtttgcacgagcagcacacgagtaacctgagaatctcgcagcgatttccctcctgcgcgctggtcacccctccttccacgctgtgacaacccactcccatttcccagatttgcgaggtgccgcatagctttttattgaacaaaagcgacacgagctttgtcaccagcttctcgcccagaatgtcgttgctccagaagagatcgtcatcaaacgtcttggtgccactttcaaacacaattggtagcaccctggtgagaacgcgaatgcaattgagcagttgcggctcgggcgttgtatcgtcgcaattgataatctgttggctcacgactcggaccagagtggctatattgtctggaaaagtctggagcgccattcggacatcgttctcgcccaccaatgtgaagatgtcgctggcgttttccggaaccatccataatttgctccagaagatggtatctgattcaggaatgctggaatccgtcgacaaccggaaaatctcggtgcgaaacgtctgtttcgactcggtttggcccattgatgtgcaagtcggtatattgagggtggtcagatggcctgaacctaaatctcgcgtacagggtgataagggtaagggttggattgtgagatgcaggcaaaaataaataaattgtgataacatagcgtagaagtagaagcagaagtagaagtacttgtacaagtgctcgtgattcataacgtgtactttgtttaatattttctaaatcaatttttaatacgttaatagtcggatttttttttttttatattttcataattttaattcatttttaatttacttttccaagcagagttttattgaattaattctgtcttcacgtaggtaggtgttaagtaaatttaaagtagaaaagtaaataaataaatagataaataaataaaaaggaaaaaaatgaaaataaaaaaacgcccatgtccaacctcaccaccgactccattcaaaaatccaatgcttaattcattatttatgcttgctatgtacacttttacacgtttagacagcccaacccattacaggtcgagcatcccttccaccatcaccacttctaccaccatcccttcttgttcttttcctcttcctccttcttggcgatggcagccagctcgttcttgattcgctcgtttcgatcctggtcatttcgagcctcgatctccttcatcttttctcgcacagccacattgaaatcaatgggcttggaagccatgggcccaaccttccagatgggctcgttggtcttggactgggcaatggcctccttgacaaactcgttgaaatactcctgccgagcatctcgctccagcatgtatcgctctcgcaactcggggttcattcgtcgcacaatatcttcttcggaaggagtggcatagcggtatcccagatatgccgatccgatgacgccgacggcaaacagaccaaacttgggccagttgggcacgccgggccgcgaccggaacatttcgacaatcggccagttttctaatctcatgattgtgtgtgtatgagcgtgtgagtgaggttatgaccaatgatgatgatggtaatgtggacaaggtgataaatcctaattagactacctgtcccactcaggttatgagttaagaggagggatgaccagtctggaatggcttagaaaaaagaaagattgggggtattataatattcaaactggcaattaggtgctaatttgacgtttcatctagcagtcaaatactcataatctgtgacactgtcataatctgtcccaaccacgtcccaattaaggtccatatacagatatttcaaaaaaaatatcgaaataagagtaaataaacctctgcaccaacatcttcgcttaagaatggcttatatgacttattgttatatctcaaatgttccctggaagctccgaaaactcctgcttgtaccactcataacctgacgtccccccatttcgacggattttagcgtggggggcattcaacctgcaaaacctggggctgcattaaccctaggcaaaagggcacgtgaccaaccttattttgaaatgtccacgtcataagcagatcgtcgtgagtaacctactttttgagggaaggggctggtaattgtgaggaatgtagttgtcggattcgagtttgaggggttcaattttttcgccaatcgagatacaactcataattacaagtacttagtttcatcaagtgcatctgtggaacatttggtcatgcacaccacggactattgtatttttaggtgagtgattggtgacatgatagtcgatgagacacggacagtttgctggccgggggtttgggttcttttgagtgggttttttatatattttatatattttatggatttttgatttttcaattattttcattcattttcttccattttcatccattttattccaaaatcccccaaatcccccaaatcctccaaattattccaaatgattccaaattccccgttattccaactcgatcgataatgaaaatcactccatgcctactgcacacacagctcattagctacaagtacaagatcgaacttgcttgtacaagacttttccagtctcaatttcggtttattagcttctctgttccatatgattctgtgcctgcggtcgggatcactgagtcagaaaagcttattttcacccgtgtttgctccggtttgttttcgtgccgaggcaggaccagttagagcgacgtcggggatttgccggtggaaaaaaaaaaaaaagaggtggtggacatggtcatggagcagcagactcccgcagcagaacagtctgcgagtccaactacttggccaaagcgacttgttctacaacttggccaactttcagtcttattctccaataagaaccgtcctcagcggtctacactctgctgtgtcttttgcgcgcgccttttgctccttttttttgctccttttgctccatagttggttttacaactgtatacacacacatactatgtacaacagcactctattgttcgattcggcggacttgagtgtggggacatgtgggggggggtagttacaacgacggatataagaatgggtttttttgggccaaaaaaaaaaaaaagaagaagaagaaaaaaagagtatagcgaaatacacagaaaccggtcaatcaccactcaatggtcaaccgccacttgtcttctccccagcagaagcaacgctcccgctcgttgcaggctacatggactgtgttacacgcacatagacaaagtactccaatctcgctctcacctcgggtgcttgtggtcaaagaatcatgtcgattgcaaatgcaactggtggaggttaaaacgtgtaccccaactttgccgagcgtccgacaagtgtcggaaacgaggtctaaaaacggcaataatgggcggcgacaagggccaaagtcgagaacggggcgaattggatatgttccatccctgcggcggccgtcttggggtcaacagacgcttttctttggcccctctggtccccagattccccgtttgaccttcaaatccgcctgcatatccctataaccttaatttgcccactcggtctgtgggggccgagagcacagagactatataagcaagcggatccccagtccccagctttggattctatctgcaaacagtgagtattattgtggggtaaaccaggtggcaggtggcaggtggcaggtggcaggtgtggcaggtggtggcacgatgggggctggtggtggtacgaaggtggcagcaaagtcacaccgagccctcacgcctcctcaaaccaaccacccatgtgactcaacagcctctgacatggcccacacaccagccagcgctactcagaaccgcgagcgggatccaacgtccactcctctcttcgacaatggggcctggtctgccggatagcgcttccgttgtacctgcacaagagatgcaaaaaaactgcacactccatactaaccatttagtgactactgttccttctagcaacactgacgccattctcaagggtgttgagatccgggctaacatccccgccaacgcccagcacatcttctccaaggaggctctggctttcatcgccaccctgcaccgaaccttcgatgcccgacgacacgagctccttgctgctcgagtcgctcgacaggcccgaatcgatgccggcgagttccccgacttcctccccgagaccaagaacatccgagatgaccccacttggcagggtgccccccccgcccccggtctggttgatcgacgagtcgagatcaccggccccactgaccgaaagatggtcatcaacgccctgaactccgacgtctggacctacatggctgactttgaggactcctctgcccccacctggtccaacatggtcgatggtcaggtcaacctctacgacggtgtccgacgaaccatcaccttccaggcccccggtggaaagtcttacaagctccgatccgacaaggagaagctccccacccttatcgtccgacctcgaggctggcaccttgatgagacccacttccttgttgatggcaagcccatctccggtggtctctttgatttcggtctgtacttcttcaacaacgccaaggagtccgttgctcgaggcgctggcccttacttctacctccccaagatggagtcccaccttgaggcccgactctggaacgacgtcttcaagctctctcaggactggatcggcatgccccgaggaaccatccgaggtaccgttctgatcgagaccattctcgccgcctttgagatggacgagatcatctacgagctccgagagcactcctctggtctcaactgtggccgatgggattacatcttctccttcatcaagaagttcaagaaccatcccgagtttgttctccccgaccgaggtgacgttaccatgaccgtcccttacatgtctgcttacgtcaagctcctcatccagacctgccacaagcgaggcgtccacgccatgggcggtatggctgctcagatccccatcaagaacgatgctgctgccaacaaggttgccatggagggtgtctacaaggacaagctccgagaggtgaccgccggccacgacggtacctgggttgctcacccccagcttgccatcatcgcctccgaggttttcaacaagcacatgcccactcctaaccagatctaccgacgacgagaggatgtccacatcaccgctcgagacctcatcaacccttacattgagggcggcaagatcaccgaggagggtatccgaaagaacctgttcatcggtcttggctacatggaggcctggctccgtggtcttggttgtgtccccatcaactacttgatggaggatgctgccaccgctgaggtgtctcgatctcagctccaccagtgggtcaagcacggtgttaccaccgccgaaggcaagaaggtcaccaaggactacgccgtcaagcttctcaacgaggagaccgacaagctcatcaagaactccaagcccggcaacaagtttgctgaggccgccgcttacttcaagcccgagattgttggcgacaagtactccgacttcctcaccactctcctttacgaccagatcacctccgttggcagctcttccaagctctaagcgcgatgtgttaaattgtgaatatttatcaatcaaattgtttatgaattaaatgaacatatatatacatgtagagttgatatgttttgtcatatgatttagcatcatgccatgagagaattgcttttgtgtgccaggcaggcatggcgtgttttcgaaagtacagtactcgtatggtctatcattattcattcaaattagtctatatgctacaagtagatcatctagttagtatctcttcatgtcgctggcccaggtccaacgaacgtctaagtcagctcgctccaaatgtaagggaagatgacgatgcaagcggtgaccagagaggcgacaaattgcagtagcgacgcgggcagcttggcaatgccgttggcctgcatgttgcagattccgccgtagatggccactacgaagaaatgcgtaaacaggtacatgggtcgggggagaactccagccaacagcatgacggggtggtccacacagatgcctcccagcttgaagtagttgaagcatccgagctgcaggattcgcaggtagtccgagtcggcggcgaagagcgagtagagggccatggagagaatgttgacgatggagtcgaggtgttttcgctgccagtggaactgcgagctcatgacggaggacacggcataggtgtcttccaggttaacgccggtgagaagtctgctgagtagaagggcatcattgagagcaacggtcattcctcctccggtaagtggatgtcgcatgttgagtgcgtcacccagcagaatcaaaccgtggtgatcgttcttggaggccgacaggaaagagttgggcatgactcgaatggtctgctccttgagagcggcttggaaagacggctggatggacttaggcaggtggggcatgacgttcttctccatgtgttccttgagggctccggttgcattagaggggacgggtccctgaatgtcacacagaattcgggtctctcgagctccaacctggtagacaagaacgggacacgagttgggcgacagaatcacgtggccatgctggggggagggcagaacagcgtccttgagaatcagaccggcgaaatgcgaacgcacagacgtcttgttggtgctaaagtcctttcggaacttggaaaaagttccatcacagacgacggtgagaggagcaaagaagtgcttgtagattttggcgcctccagttttagagaaggtcttgactccaataatgtggccggtgtaagggttcttgaccacctcggtgactgtggcctccagcagagtcacattgggtgtgtctcgtgcggcccttcgcaagttcatgacaaatcggccgtggtggaaggatactcctcggggagcctcgttggagatgtcggcagactttccgcttctgtacagctcgttgtagtcctgctggatgtctcgggggaccttggggtatttgagaacgcactcttctccagagtagatcacgttgtatccctggcaggggatcgcgtcgatatcctcgatacaagagccgagacccagagtcttgagagcagcgactcctccgggctgaagcagctctcccacgattcggtccggttcggagagatctcgttccacaacaagaacctttctgccctgatttccaagagccacggccagagcgggcccggcaataccagctccgacaatgaccacgtcgtactcgttggtctgggtggcgctggtctctgctgcagactgttgggtgaccattttgtgtgagtgtgagtgtgggctgttgtgtgattaatttatgtgagcgttgagcgagagactggcggtttgtaaatgcgtcggaacgaatgtgcgggcgagagagcgtgggtatgttgttcttataccaccaagtatcacctgtttacgcagtctggagaagtggtccaactctgcaatctgttgctgctggtgatatttatcgttcgattcaaaaaaagggcgatgttgataaactttgtccgtggctctgatgctgatgtgcttgtgcttgtgcttgtgcttttgtttttaacgtgtttgctctcccagaagtgcaggtccggtgggcccgagtggtgtctgtgtaggagaagagaagaccggcgtttcgtttgtgtttttacgagcgtttttgcccccccccctttcctgctagctctatataagtcgtgttagtatctggcattgttctcgaccgctattactcgtacagctaagaccgatttttttttattctcccccccccggcacacattttgggtttagacactttgacttgtctcgtcgttaacggtcgcatatcctcgcgtggctcgttcactagttgtttgggtaacaccttgccctggactgggccaaaagcgcgtctagcgagcgctaaattgcatctgcaggtgagacggccatcacaagccgcactgacacacatccacgtgtcgctgaggctcgcgcgacgttccatcgtgccatgttgcaatatcacatgtaactgtggatacacgtctgttatgccacatttctccgctcgcagatttttcaaccagaaatgaacacacgctccaactttaaatggttgggcatctgagggctgagacaggagaaagagaagaaagaaagtaatataaaataaaataaaataaaatgaaatgaaataaaataaaataaaataaaataaaataaaataaaataaaataaaataaaataaaataaaataaaataaaataaaatataaaaaagacgttcacatgaatgatataattaattcaacggaacgtgatatctgctgtcctttatatatatatattttagtattctctcgattcatcacatctatatatacatgaagccgggttgttggcgttaatcatacacttgataatctcgatatgcgtttcgaggcgcaagtctttggttcatcgtcctggtctcgagttagttagtcataaatcgtatcaatcgtgttttttcttctcttttttatatatgttttttatatatttattctgggtctcctgtcttctccaaactccttggtttagtttgatctcgaagggaccgtagaaggtgtcattagcatgggaaagattcgtgtgtatcttgattgagtggtagtggaatcggggagtaggagtattggggtgttgtgttggttttttatgttttattttattttattttattttattttattttattttattttattttatgttttaaaataaatatatatatatttcccccaatattccattttcattaatcagtcgtcagcgagtttattcagcgcgagcagattccacagatacgcaatgtgtaccagccattgcaataatcctcctacttgtagagtgaaatcacctcggcgctcattcgccgctgcgcatccacctcagccatgacgacgatatgctgcagaaactcggttgaacaagcgagccagtctcgctggaccaaggggtcactacaagataggccagtttttcgcatggctcgctctaatgtagttcagcgggccgtccttggcctccagtaagatccaacaagattcagccgccattttagatggaagggacgtcaatcttttggcagaaggccttgcatgtgctgaaggaagtcatacccggtagtgtaatacctggctaattcctcacataatggtgagatgtcaccacatagtgatgagagaaatcagctgggtcgtagacgacgagatgtccatcctgtagatagttttatccactgatctagtcttttctggcgaatgagcaagcacacacccttctggtgtgtgctactatcggagtgggttgtaagttgttaactatatcacatcaataatacttatgatcttcaataggatgttggacaattgacataaagatgctcgtgaaaataaaaataaataaataaaataaaataaaataaaataaataataatatatatataaataaccctagggaaatacgtgatctgcagtcatcatcggaccctcaagtgaatagccgctgcacaatccacagccttacgaagttcgattccctcctgcacttaacggccaaaccacacggaatagggagtaacagcggggcgagaataccgaaagaaaggaaaagaaagacaaaaaaggaaagaaagaccaaaaggaacccttccgcattcatacaacttgccgattcattgaatcgagcatgtacgtactccccgataagcgatacagcagttgactctagatacacttgcggggacatcatactctgtacagacttgacaagtgatcaggatcagacttgacaagtgatcaggaccttatccagcaaacgacatgaaccgcaattgccacacaatattccggtacaagtgttcgcactcgaactgtgcgcctcaagctagttttccgggtggcgccagccacatttgccctctatctccatgcaggttcgagcatttttgaagcgtgtgtgagatggctatttaattaacccactcccaacccagagaacatcagataacacaacctcacacgtccacacgtccacacaaaaaaatggaccactctcaccacatgatggaccacagtggccacgacatgcccatgcccgatatgcccggccacggcgacatgcccgaaatgtgcagcatgaacatgatcttcaactgggacacaaagggcatgtgcgtggtgttcccctggtggcacgtcaagacccatgtgggcatgattctgaccgtcatcgccgtggtcttcatctccgcaggatacgaatacgtgcgaaagctgtcgcgggacattgatgccgccttcaagggctccggtgagtactccttttgatgatttccttttgatgatttcctttgatgatttccttggatggttttctttttcttcttttcgtcatgttcctttggacaatacttatacagactgtgatctggaaccgattattaatccagacgttcgaccttcggaccagaaaaagatccgaatctacaagtccatcttctatggattccaagtgggctacagcttcttactgatgtgagtatgacatgatgcggatgtggtgtgggagtgaggagggagtgaagatatgtgtgtgttggatgtgatatgatgtgatgttgtgttatacactaagtgtggactaacacaggctggtcttcatgacttacaatgcctggctcatggctgctgtggccattggagctggtgttggctacttcatctggggcggtaagtccagtgagcgatccatgtcttgccattaagagagaggcacatgtgacagaaatttaataactataataacgaatataacgaattgattacgtgtctatggtgtgtgtattcgtgcaatccaatacttctacaaatgttgcctttttcaatcgtttattcaataaatgcatgcctgagtcgcgcttagtactcccaagcgtcctcaagaatagaggtaagggcctctcggacctcggcctcctcaacaccgtggataccgggggcgagatcaagaactcgtcgttgaggaacggcaccgtcaacgagagcagaaatgtcgcttcgcttgtaaccaagagcagagacaccccggggttggtgcttgagcttagtgaacatgaactcttggatggcctcagcaagcacctctccggcagactctcgcttgacgttggaaacatcaacgccaaacagagaggcggccttgagatgtcgctcggggtcgctgggagcagtaaacttgaagacagaaggagcagtaactgcaacggagataccgtggggaaccagaggatggtcagtgtggtagtcggggtggtagtaggaggtgttcattccagagatggggtaagagagaccgtggcagatgtgaacaccggcgtttccaaaacccacaccggcaagagtagatccaagaagcatgttagagtgggcctccatgtcttcggggtcggcacaagatcgaggaaggtactcaatggccagacgcagaccctcgagagagaaaatatcagcaatggggttggatccttggtaggcaggtcgcatgttggggttgctgggacggggggttcgctgctggtaggggatggcagtgtaggactcaagagagtgacataggacatcgaggccggaagcggccttaacctgctcgggcatggtggcagagttgagaggatcgacaattccaagcaggggcttcagagcacggttagcaataccggtcttggcctttcgggaaacgagatcgaagatggcagttccagtggtctcggatccggtgccggcagtggtggggacggcaatcagaggcttgaggtcaatgtcgatgggctgagcctttccaatgggggcgttgacgaaatcaagcagctcagcgtcggggaagcactggtacaggttggccatcttggcagtgtccatgacagagcctcctccaatggcaaggtaggccttgggctgcttagctcgtccccaggcaatggcgtcgagcacagagggctctttgggctcaacgcacacgtccgaataaaggtcgtatttgattccacacttgtcgagcgactgcagtgcggttttgacggcgggggtattgagcaggttcttgtcggtgaagacagccacccggtcgattcgcatgttcttgaagtcgtagcccacctctgccgtcacgccggggccgtatcggatgttggaagcggccatctggaacgcgtactccgtctccttgtgatcactggcgtagtttctgtgtccggctccctgcatcaccatgggggtgaaagcccgctggtaggctccgaagttgtgtgaggtgatgccatttacctcgaggccgggaggagggttggcctggatggttcgcagcacgtttcgtgcaaggttcgtcgacgttttgaccatgtttgtgtgcgtggaggagttgtgatgttgtcgtggtctcttttgctcagtggagatcccaagccttatatgtactcgaaccggggggttgttgtttcttagtttttgtcgtgtctcgacgcaccttccgttttatgcggggaagcttatgcatctaggttgtggggggagcctagttgacgcgaggtggtgacgaccaagtacagtacaagtaactgactcgtagttggatgaagataagcaaaaagtagggcaacacggaagcgggactgcagtatatatatatatatatatatatatatatatatatacaaaacccgcttgtgtaacatggattaaagacgcaaaaatcacaaggatcaaaccactaaaaaaaaaaaactaaaaaaaaaacaaaaaaaaaaacaaaaaacatcacaactgaagcttctcctctactctactggatgtacctgctgcacctacacaagctccgcactaaccaaacacgacagctgcacctgactatgatagtgtggggtaatatgtgtgcgggagctcgtatcggcgtttttccaacatgtcctcagacgcaggtgtccattttcgtcattccgccatctcgctggcctcatgctcttgcccttttccttgacggatctctcggatagtggcggctaaacttacctttcgctttcgggcggaaggctactttcgggatgatgtgattctctatgcaacacgccgtgacaggagcgacatatccagctcatttgttggtggcaatgtgaactggatgatttctgggtccaacagtgcaattatcattacagcagtagatagtccggtaccacccatcacgaggtaaacgccgacgcgggggtgagtgagctctttttgacttttgttaactccgacgaaatttgggggggggagagggatttcgtgcgtccttgcatggtctagtccgaaactaacaacagctcaactggcggatcaggacactttcagacaagtttcaaacagcaaattcggagtgaagaaccctcttgttgctctgcttctcttctgtgggtcgcttctttgtcttctccgtgtttttgccgaactgtacatcagcccacattacaaaactgcacggtgcaggacacgtttagccgcccaactatggcgaggtgggggtcgtcggaacgaggttcagaaaagaaaaagaccggctcgagggcttccggaggataaaaggaccgttcaaatgagtatctccacccgcctttgctccaattgttgtttttggaacgtgtgttgctggaggtgtggatcttttggcagatacaggtatggacgttcagttgatagacaccaagtaaactacttgtagttggtcatatgcatcgtccatcactcgtgttaatttcgaaggaagctgtttatttgatgagtagctcattttccaacttactcggtgaacgttgccagcggctggccggtattggacaagatcttactgttggacaagccattgtgagtcctcttgtgggtgtgtttggatgaaaaacagaaccaatcgcgagtctcggcccgactccactcagaccttttgtatctggataaatggagtgtcgcttggctcaggggtacgagacttcgcccaagttggctcaattgactaaaagtccattttcaacccgtgtcatggtcgttaaacacaccaatttcactctgatacaccaatgagtctcattggaccttccaaagcccccatttagtacttttttagccctctcgggacactggctactaacattgaacaccggccccgcatcgtgcggcttgaaaattcaggtggtccgttcgtgcggctcgaaaattgtagagcgcgggggcagttcaggggaggagcccgaataactcatattttggtagccacaccgacctcaaagtaatttcagagggccattaattgattcttaattgattattaattgatctttgttgtttcaacgtgccggaatggtctttttataggtccattgtctagttcactcagaccacatcaacaagagttctatgcagcacgagtgctttagcgacatgcaggaaataataatgagccgcatagctctccggtctgaaaaccgtcgaacaacaccattcctgcaagtcccacagatcgaggcggacatgatatggtgtaggaaacgatatataagggacccaaaagtcctgaatttggtcttcatcaacacaccggtctaccacccactactaccatgaaggtccttcttgttctttacgatgctggctctcacgctgctgacgagcccaagctccttggatgcaccgaaaacgagctcggtatccgagactggctcgagtcccagggccacacgcttgtcaccacctcttccaaggatggcgccgactctgtgctcgacaaggaaattgttgacgccgacgttgtcatcaccacccccttccaccccggctacatcaacaaggagcgaatcgacaaggccaagaagctcaagatctgcatcaccgccggagtcggctcggaccacgttgatctcgatgctgccaacgctcgagatatcgctgttctggaggtcactggttctaatgtccaatccgtcgctgagcatgttgtcatgactatgctcgttctggtccgaaactttgtccccgcccacgagcagatcatttccggcgggtgggacgttgcggcggtcgccaaggactcctacgatctagagggtaaggtcatcggtaccgtgggaggcggccgaatcggtcagcgtgtcctcaagcgatgcaagcctttcgaccccatggaaatgctctactacgattaccagcccatgcctgccgacgtcgaagaggagattggctgccgacgagtcgagtcgctcgagcaaatgctttctctgtgtgatgttgtcactatcaactgccctctgcacgcctccaccaagggtctcttcaacaaggagctcatctcccacatgaaggatggagcctggctcgtcaacactgctcgaggagccatctgcgtcaccgaggacattgtcgaggccctagagtccggcaaaatccgaggatacggaggagacgtctggttcccccagcctgcccccaaggaccacccctggagaaccatgcgaaacaattacggtggtggaaacgccatgactccccacatctccggaacctccattgatgcccagggccgatacgctgagggtaccaagaagatcctcgaggtctttttctcgggcaagcaggattatcgaccccaggatatcatctgtatcaacggccattatggtaccaaggcctacggtgacgacaaagagcataaggagcatcagctcaagtaactggatgaccacaatcagagtcactacaagcacgagctttttttccagccatgtctctaagagcccttcctatacactctacctgtactgatttctcaactacgacgacctccatcaatctctaatgtctattctatctataaataaataagttagtgggttctatgctgtatctctatcgcacaacaaacgactcaacgtcaacgccgtcatctccgacaaatcgcacatagagatactttgcggaaacggcctcgctgagccgaatggtgagctctcggggcgccttggcatcgtcaattcccacctggggaatgccggccaggactaggggggtgagctgtccagtgggcttccatcgaccacagacgttggtgggaacggttttggtactgcttccgagagtgtaagttgcctgaagggagtcgtccatgacggagttggtctggactcgggctcgagaaacaagctcgccctcaaaatgggggtccatggccgaccagcctccactcttggttccatacatttgcaattgcgagttgtcggtgagggcaaatctgttggcgaatccagcaaagttgttgttttcggtggcgtccacttcgggtgtgatggcctccacggtgtttccgcccatgaaaatacggccgatggaagatgctgaggagtcgtgtttggtggcgaaaaactgttcgacccgctttttagtgtcgtcaaaggagacattgcagggcgggttgagggcaaaaacagccacgtatttggcgggcgacgtgaacttgttggccgagggagccacaatcttgagctccttgatgctgggggctccaaggaagcctccctgggtggagtgttcggttccaaacagaaagtcgtgcacgttatcaagagacgagaaaacggtgtcatttttttgcgtcaccgtttcgggagagccctcgaactcggccttggtcatgcccacctgtttgagaggcagggtggatcgtttctgtttcttggacggaggagctcggaactcgggggcgtcttcgtggctgaaaaactccgagtagaaggcgtcggaagagagacaggcgggctcaaacacgtcctcgtccacgtcctcggcgtcgagaccgaaatcgggaacctcgaacggcacgtctaccaggggcccgaacttgggcgaacatgctaacgaacaggccacactaccagccaaagaaggggcggccgagtcgtagatgaccgaggtggatcgcgatggaggcgtctgctttcgctgtccaggggtgtatttggatttggtactttcttttcgcattgtttgtggcggtactcgtgtcgtgtgtatcttgtctgttcaagttcaagtagtgagccggacatgtatatattcagctcccttctatctgaaacttaaaaagtgcgtcaaattttaatcttccctgtgacgtcagagtgcttggtgcgcattttttttttaatttttgcctacggaagtcccaattgggaagccgtaaggtttttgagaaaagaggcacaagtcgtgataaacgcgataaaaacccaagctccgagagaaagagagcgttgtgcgtgagatacgagcaatatgaaacgttgagacgccccgaatatctttctctggcccgcttcgcaactctcagacgcacttttgccccaattacccccaccgcaagttgctagcacatgcccctgaaattaaaggcatcccaccctgcactgagacacatgaaagttgccaagcaaaaaaaacaaaaaacaaaacaaaaaaagaacacctgaaaacagttacgtcatgacgattatcagtggtgtgagaggtggtgtcggtaggacggggggaaatggctccactgtgctccagatggaccacttcaagagatcctatcggcacctactggcaaatgtttgtacgttgcaccacccttgtcttcctcttccacagccctcgtcaaccacagttgccacattcatgtctctcattttagtgtctctttccgaatactccgtcgatgctgtttgttgatatgttgctatacaggatgcgtagatgctgtacgagtaccgttcggcagcgaaagcggtacgcgtggagaaagtacattcaagttgaacattgacttccccttctgaccctcatctaattacaggacatacaagttcggcggtactgtaaagtacgaccacgggtacgtctaccactaccactaccactaccactacagtacaactactcctccaatggtactgtacgtcgcaaatgacgtcacgacagtatgaaacagtggtatgagttgggaggattacgtcaacagatcgacaagttcgagtactttcccgaacctcagagctccgaacctcagactccgaacctcagactccgaacccttgccaacttaactccgactcaagtccagtcctaaatcgatctccaactcgacctccaactccgatgaccaaatccaagacttggtcgcgatcggagtttggagtttggcgcaagaccgactgtggttctcccggaaactagcaatctaatgactaatgactcatgactcaaaccatcccggctggtgcgcagacatccggctggtgcgcagacatccggctggtgcgcagacatccgagagctctatcgctacaagtacttgctttgctctcactaaatgtctcacactctatcttcgtcggccagcatgtgaaggcatcaaatcggaggtggggtttcagaggattacagacggtgtcagaggactacagacaattgttatcgttcacttggtggttcagatgacgattcgacccctgtcagacacgagtatttgtaatagctttccacgggattcccttaccgacgaccatcaagtccatgccgttgatgaaaatgttcatgatcagatcgaaacacatgctcgtgacgcggtaaaagaatatctatgacatgccgtcttgtgcgcaccaccccgagatggaagaggtactgtagagccgatgatcggtatcctttcagaccaggagaactgctatgagtacctgagcataagtgaatggacctgacacgagtctggggaacgctggtgtttgaggtcctaaataccgaagcaagggcgccttcagaacggtcgtattctcgacatttgcccccaaggggtctccaagaatacgggttgtgacttcatagacatttggaatagagctaccagaagctatctcttcataaaaacatcaaaacttgcatgaccatttgccaccaaaaaccgtcactatcccatgacacgccgagtattcgtggtcgtatctccaatttaattctctcggtaatattatacgcctcgtaatcgaacccacaatctttcatcatgcatcatatatgcaggataatttcaacggaaacgcgtgaagtgattagattagccatcgtcgcacaccaaccagcaagaagaaaaaatgtcggtgccagcggaacagctggagaccttcctgccgtcggagctgcatttcatggcggagaatgagaccatcgagatcctgccgcgacgagtcggcaaccccatcaagctggcaggcacagatctgcctctcatgcatcctcttcgaaagaacagagtccccatctggatggccatcgcgctcaagaaacagcagcggtgtcagttcgtgcccccggactggatggaggaaagcaatttgcggcggatcttggcttttgagcatgccaaccccaccgcgttctccaacgtggatttccactggctggaaatcgcccagattgtgctcaccaccgctccagacgacctcacctcgccgccacaggtgatccgaaacctcgtgcgagatatccgagaggtgcgggagcaaaaaagtcgacagggtatgaaggaggtcaacgaaaacatgctgcagatggaccgactgggggctctggagatcaacgaaatgagaccgtttgtggtagaaggcatggaggaaatgatcaagatccgcaaggccggcaagaaggaggagcccataatctattcggaaagtgacaaccccgaggacgacgaggatgatgagcctacttatggacatgacgacgagtcttcgttggctgtgccttcatctcaactggactcttcgttgcgatatggagaccgagtggacacttcggaaagaagacgagagttgtctcagtgggatgataatgtgccgcaacaaggcggccccgaatggtgatgtttctcagatacaagaacacatcttccaacatgtacactaatgaatatatttattgtaatcgaaaccgaccaaattgaagtattgagggacaagccacgaataatgataagctacgtactgtacatgttgttacaagtacagggtacgagtatgtactgtatcgtacaagaagttacggaaccttgtaggtttggagactgcaatgacttagcatgcattgaatctaccagcacccacaatatcatcagaagaaatggaattggcgttacttggtggtggttgctggctgttcttgtcgctcttgctcttgtggcacaactaaacatcaacttcggtaaccttgacctccttgaaggtgacgagcagaagggcaatctcctggttctcaatgaactgcttggcgtcggggttggccttctcgtgtttagcaaggtacttttgggcctcggccaggtcctccaccactcgtgcggagccattgagagtcacactcatggagctgatctcgttctggttgatgttctgaagcagctccagcagcgacggctcctggccccccaccacacgagatcgggccgtgacccagtcgtgcacaagcacagacactaatgggttttgcgatagattgacatatgtggtggaggactttcgagtggtcaaaacaatggcctgctcgtcggcaatatacgtgtagttcatgagggtcacgttgggctggttgttgtggcacgtgcccaaatgcacaaatccagcattagtaagtagctgctcgacttctttggaaagtgtggccatgttgaattggtgttttgtgtgttggtaggtggtttggttgtgttgctggagatgtggggagacgcatgatacgataaatatgaaaatagggttttttgtcttattaatagctgggcagccggcgccctacaagtaggggacaggtatgcatggaaagagggaccaaatttcggttcaattggttgtattgacggcaatcgttctcaaactcggcttttttgtccgacatggcgtttccggcggtctgactttttttttttcttttttttttcttcttttttttttcttttttttttcttcttttttttttctttttttcttttttttacgcagcagtcttattttatgatgagattttcgtctaaaataaaaattaaaaataatatatgtaattcaatataattctattattaagcaaaataagtgtgtttacttaatatttattcacagttctcttcttttcacatcccctttcttactccaatctccatcccggtattgctgcggtgcttattaatcaacaccatcgaccattaagttcggtacatgcacaacaccaggtagaaatatcatgatggatcaatacgttgacgacactagacattgacgatacacgcatcgacgatacacgcattgacgatacacgcattgacgatacacgcatttactacacgactttgacgacacacgcactgacgatacacgcatttactacacgactttgacaagagctggcggaaagacattataaaccaccagctggtacttcatcattgacaccaacactcacactcggtcacgacattactaatagacactactatttacggcatggaatcagaattccccgaaattggcggcgaaatcaccccgacgggcgacaaaatggacgtggaaatcgtcgaggaagtggtggaacctgcagctcccgtgctacctcctccgcaggtgcccaaacctgaagctgtcagtgagaccatgattgataccatcaaatccagaacgctgtcaattttgacgggcaaaagcatccctgagccgatttttctcgacggcgaaaaggcccgagtatacagtctgatggagaacgccattcggtttggagagggaaactcgtgcattattgtcggtcctcgaggaaccggaaagactctcattgtggaatctgcactgacagaactggaagagaaatacaacagcgcgggatcacaaaacaacttcatcaccatcagattgtctgggtacgcccagacagacgataaaatggcagtacgagaaatagcacgacagttggacactgtgttactaaaccagggccaattgattgagaacaagagtatttcggagactctcaatcagatcctatctctgtttgaccgtgccgacattgacgagagcgaaaaggaaactgtctctttggttttcattcttgatgaattcgatcggttctgttcaaccactaaacagacactgttgtatactctgtttgatgtcgcgcaatcatcgcgtgcacctattgctgtgattggactgacccctcgaattaacgcccgtgagcttctcgaaaagcgagtgcggagtcggttttcacagcgggtggttcaggtcaagagacagcacggtatgaatgacttctgggccattctcagaaacgcagtcatttatcctgaaaatctgttgaccatggtcaaggaggagggcgggaacaagacagcattgcatactgacgtggatctggacactgtgagatattggaactggcattgggagagcatgtttcaggccggtcctctacgagatcatgttgagcgtctctttcacaccacgaaatcctgtcgggagttcttcacatcggccattttggcggtgtcgcaagcaaacccctggatcaaccccaacgactttgtcactgatgtctttgagagaggcgtggccgataccgagtcgtttattgaagggttatctgacctggagctgtctctcatcatctgtgctgccaaggtggaagttatgttcgaggttgatcaggtcaatttcaatctggcctatgaagagtacatcaagaccgccaaggagcagagagaagcccttcgagcggttgatctggagggaatggccacgggaacagttgctgggttccgaatctggagcagaggagtggcacgagctgcatgggagaaactcgagtctctcaacctcctgtctccggtggagaaaagcgccaagcgagtggccaaacaattggcctcagacacttctctggacgacgaaatccgcatgactcgagtggatgtcagtctccaggagctgactaacatgcttggaaactctcatcatctcattcaatggaccaaaatccgtaggtaaccagccgaccatgtatgtacatcactaatacaagttcgattagaacataatcactctggcatcgcgatactaaaggaaaccaggaacggtgagaaaatattattggcaagaagaatatgtaagtttttttttctattaaaaaaattaaaaaaatggataaaagaataaaaagggggtcatcccgggtttgaaccggggtcacctgcaagttatgattgtactgcaatcacaggatgcttcagtcgcccgaagcaggcatactaccactatactaatgacccagtttttattgttacagtgaatttttaatataatccaaagtcccattttttttgccaaaaaataccaatctctgccaatatgataagaaaaacatattaaaagactttaggagacctttaggagacaaattaataatcagaacaagttttaatctttccctgagcgtaatatagccttaaaaatgtctttcaaaaccacaccaaaaacgtggatttcaatggatgtggaatagcgcttggattgggactgttatgtcaatgaaatcgtctagaatcctttttcacgggccataaaattgtaatacacgatattccttactaattatagatctcctagatgtcatactgagtgctggttttttttcaggcccaagaaacgacacacgaatgtgacggaagagctgaaaaagagtattaaaacaagtcagctagcgtttaaaagacaattgaagatgtatccacttttacaatcatctcttagaaccctttcaagtccgattttcgattcctttttctgacatcctcatattgattattcagcgacagaaatgcgctcatagggatataatgacgattaatatttgtacataaaatgagtgacaagagtacaatgtatttttttaaccatttctgtctatatttaacatacatttccccagtttttctgacgacctggacgtggacctgaaacacatgaattccatgagagacctacatattattagaagagatgtacgtaaaccggcatgttatctgcccgacatccatctgattcagattgactgttggaagagtgagctgactggcctctttcacggtctaatcgcgctacacccatacttgtacttgtacttgtacaatcatcctataaaatatataccaccttacgcgacaatcttgtcggcgtacttaagaaccaccttatcaaacagcgcattcttctcggctagctcctcgaaaatggggtgcttggcatccacctttttcagctcgtccttaagctcggtcacatcgtcgccctcagacagacccacgacaatcttggccatgagagcattgggatcctggggggccacctcgtcgaccttggacagagtctcctttgcctcgtcgattcgacccagttggatttctgtgagcgcctggccaagcagcatgttgccagtcttgtgctgcgagagatcctcgaaaatgtagtaggcggatcgcacatggtcatcgccgttggcccgcatggcgacaatggcagaggccagcagataggccacgtcatcatccgaggttcgagcgtagtcacggatgagtttgtgggcagcgtcgatcttgttttggtccaccaggatccgggcggtcagcaaaacggcttcgaacgaaccctcgtgcttctccagtagagaaagcgcctcgtccatcttgccctcgaggtataggcccgtggcgccaaacagctggacggcttcgttgtctgtgttggatgacgccagacccgacagaatggctgcgtccttgtgaccagaggccacaaacttggcgtaggctttgagggcctctctggtggccggagaagacacgtcatcaaagctggcggggctcagaccgctggcaatctcagcccggtacttgaggaaggccacgccatctttgtgttcgtctctgatctccgacggagaagaggccaaaagcgacttggtgtcgccggtgaaaaacgccaatcgcgcgtcgaggatatctgtgttagaaactaattggggctgtaaggcgagtcggcttactcactctcaatagtagacatgttgtgtagtaattgaacagtagagaatgtcgtgatgctggcacatgcatatgccgacgtgttccatagagtttgattagtcagcgggtagtggactagtgatgtgtgaaatgggtccgtgaatgtgatttgaaatggttaagagagatgtagatggtcggcttggtgtattttgtgtcttgtcttccacgggtatgttgatgtttagaccatggattgtgttgtcagtttttgaggaaagaaatttaaattaaataaattaaaattaaataataaataataaataaaagaaaataaaataaaataaaataaaataaaataaaagaaaagaaaacattactagctagtaactacttgtagatcgtctcatgctctcatcttacgaacttcagccacatcaactatcaatatcattcccctctggttattctacctccatgttgctcgtgtgctagtgatactcatcttgttcgagtgaataccagttcgaaatgaagttcgtcagaaaaatcgacaaaaagaaatactcactcgactcaacaactggtgctggatctacacagtcgacaagaaaagaaaagaaaaagaaaagaaaagaaaaaagtctcgtcatttggcgcttatgtaatgatcacgtggagatattgacacaatccaagatatacagccatttcgacatacaataactggatgtagagtgatactagcgcaataaaaaatacctgatttgtgtgctcccctggtcaagagctgtcgattggaaccacttttgaatccattgcagcgatttccgcacacattcattggaatgcgggacagatcggtacgatatagctttcgactcacacacgcccctcgtcactttcaacattttcaatataataacatctatttattcgtgacccacggccactcacttcggttgtttgctgctctctttccttacagcttaatctttccggatcccagagaagcccagtctccagcatcgagctccacgtacttgttgcccttgagccagtaaatggggctctcgccttcctcatggggcatcttctggttcttgtacttgaccttctgcaccttgttgttgccggttcgctcaatctcgtcgacaaacttgatgaacagaggcacggcgtacttgggcagctgcttgagcgagtactcggcaatctggtcaaggttgggcttgacagaagcgtccttgagcttcaccacggcgaaaccagctcggccctcgtgctcgggcaccttgacacccacgcagacaacctgctcaatgttggggtcggaagcgccaacgtgctcctccacctcggaggtggacacattctcggacttccatcggaaggtgtctccaagacggtcgacaaagtagtagcactgctcgtcgttgagtcgcaccagatcaccggttcggtagtaggcatcgcccttcttgaacacgtctcgcataatcttggagttggtggccttatcgttaccaaggtatccctggaaggtctcgtgcaccttctcggggttggggatcttctggatgaactcaccgggctcgtcggactgggcgactcggcagaagccggtctcggggtctcgccacagctcagtctcgtcttcgggatccacaggaacgatggtctgtcgggtggccaggatggcagccagaagcttaccgtatcggcccatggcaccgataccaatctcaccctgctggaagttgttggttccgagaggaccctcggtggcggcgtaaaactcgccgatggcggggatgttgaatcgttccttgaacttgacccaaatatctcgtcgcattccgttgccgaacgccaccttgatctggtgactcttctcgtcgggagagggaggggcgttgatcaggtatcggcaggtctctccgacgtactggatgtgagtggcgttggtgagcttggcctgggtccagaaggtggtggtagagaactttcggccgggggcgtaagcggctcctcggttgaggcagggcagacagccgagaatggcggcggtggagtggtagagaggcatggcggagtagacgacaccgttgttcttgagccggatggagtggccgtagagcgacgacatgagcttggccttcttccacgacatgatggcgggcttgggcagaccggtggttccggacgtgtagatgagcacggcagtgtcatagtccttctgctcgggatgtcgctcgtagtcgggggctctgtaggccggggaggcggcgtaggcagcgaggaagtcgtcgtccatgaacacggtgtcgcacttggcctcggacttgatctcggccagcgaaggtcgcacgttgccctcgacctcggtgtcgacgaacatgatggaggcatgtccgaccttgaggcagtgcagcagcgacttgtcggccaggttgtagttaatgaaggccggggtggcgcccaggttccagatggcgaaccacacgataatgaacaggggcgagttcatggcgttgagggcaatggtgtcgttggcggtcactccgtacttgtttcgcagcaggtgtgacattttcagcacctcatcgtacagctgctggtaggtgaaggtctccacgtcaaacaggtcgtcgtacgagtcgccgctgggcttcttgccctcgatgggcttggggtagacgattgccgggttgttggggtacttcttcaccgcgtcttcaaacgcgtaccagtattgcactcggcccttccaggcgttgtagaaaaaatccagaccgttggtcatggcgcctcggatcatgtaggcatcttcggagatgagcgtcttggcctccaggtaggcggctccaatggcggcggcagcaactagtccagctgtcattgtggttgggatttcgacaaggtgatagtggagaaggggacttaaaaaagggcagccacggttaatataagggccagcatgaaaaaaatggggtatctggggttgaaccttaattttgagactaggggttcgggtttgtgggggatgtggaggagatatgggatttttgaaaagtgcgttttgattctcggattttgttattttcaatatcgttttcatttttcaaatacctccaaaactgggtattctggctgaaccaccttttggccaatgtggggtcggcaggacgtcatcacctcggctcggtactaactttatttggtctccagattacatgctttaacacatggcaacggtaacgcaccgacgtggaatgattggttgtggcgatgaggagtcagcgcggaagctacgagcgcttagtaatttggtcacgtgtgtgctatttgacaacgcacccctgattaagtgtggagttcccaaatatccgcgcttttagtcgccccaaaaattgccaccactattcccaatccatgttacccccccctttgaaataaactcgtcgggaatttcaggacagcacatgaaggttcggcacacacattgggcatttgcgcggggataagtcacgtggagaaaataagacgcatgtttggacgcaattggggcgaaaaatgggggatttggtgttggaaaaatcaggaaaattgggggaaatgggaggaaatggggaaaatggggaaaattgggaaaatagacaaaaaacaggcaaaaatagacaaaaaatagacaaaatagaaaaaaaagaaagaatagaaaaaaatagtggcgcatgctgaacagtcacgtgagtccatggcgagggcagaaatgcgcagtcacgtgagctgcatctcagcacagaaaaaaagataacacgctcgcaatttcccgttccgagtctccccagcaccgttccgacattgaaactcgttccattggccaaaccatgtgattctaggttctgtgggggaggagggaatgacgtggcaaaaatggacttggacctggagaatgagtaagcaaggaacatgtagctgattcggcgctgaattgttctacttacgtgaaatttcgacggcgttcatttgcgttactctatcttcgacggcccagtcatatgttttatcattctctttttgcgtctcacttaacgccaacggtattatgttgcagtctaaccttttcgcgcaaccgaaaaataatgtcaatattgtcggttcattttgttttttttttcaattattttgtttttgttcgatctgatgttccccgtgttctcgatttaacgttatttatataaattttccgaaattcaacgtgaatcaaaacaattcaaaaaatcgaaataaatcagaaaaaatcaagaataatattccccaacaacaactacaaatagattcgtattattccgtcctgcggggtgactagcgcagataaatccgctaatgcatgaccacgtcgtggattactcaccctgattactggccatcatgcagacaaaccagattcggcgttagcgcttttagtgcacgaggctcagatggtggcttattaagcaatgtgcgtctagtaagcgacgtagcttattaagcaaagatgcttactcagcggagtgactactaagtgacgagacttactaagcggcactgacaagggtactgcagaatcacatgtgtggagagcagcacctgtttttgtctcacgtgactgatcacatgaccaaacaaaaaaaaaaaacagaaaaagctccccggcacccttcaaccatacgagttgtgtgcgcgtccttctccttagatgacgtaatttaagtgtgaccagtcacatgaccacccccttcaccgcttcttcctgtatctcacgtgactgactggctggtcacgtgacccccaccatcacccactgctcccccatctctactgcgtcttagatgcattgatcatgcgtaatgaactttaaataataaaggtcgaaatttcgaggggaaaattggacaatttgaaaactgtttgaaatagaatgtcattatttttgccttattcagctgactctgaatcagtctttgaaattgtgttgtcgtccttagtcagcattctggagaccccccgttgcactgtttgcactgtttggaccatgtataattgtaaataggggtcaaaacaaacaatgcgaggcaggctgtctgtgtggcagaggtaatgagcgactgaaatgattagtcacaggacgcgagaggggtgggagttatgtaactaaagaatttactcacgggttttatatctatcacgtgaccctgctctcccgctcactgctaagcgcttactcaacaccggatccacctagcaacgggcccatgtctcggtacatagcgttcaacggggaaccataatggtcataaccataacacgagtgtgattaagacgagttggattcccagacagtcaattggtctgctggaaagggagttagtaagacggcgttacgtaattgaacatactcccttgatacgatgactaagttgagtgatcaagcccccatttgggctttgtcatcaacctcctgatttttttttgatcttgacactgtttgtatttatacaaaatatagtttgggtctaaatgtgtttgtgtagtttcaaatttcaatcacattttattgacgctgtgttgggattattattaatataaaactaccattgtaattcactcatttcatgctacaaaatgcacttttcagaatcgaaaaatatccagtcaatcgtcccacagacccacagttttatttatagggttagggcttcccaatacggctcgtcccaaacataaacaagcccgaaccttatcagttcactaacaagtatatgtgtagatgtttttgagatcttcttgagcagagtctgtggagttgtttgtgcgatagaagcgaacgtttgcaccattacatttttgtgcgtgcccatcaccttgtccttgtcgtccccaccacattgccagtgtcaccactacattgccagtgtcaccattacaccatctaggtcaccccaactacaacaccttcaccaccttcattcctccactccacactacgatgaaaaaagtggaaccaatcgagttcctcaaggaccgggtctatctcggagcatatgcgcacacccccaaggacaccgagacgaccgtctacttcacggtcgacgatgctcttccctacaacccgtttcatctggatttcgggcctctgaatgccggtcatctgtaccgatttgcggttgctcttcacgagattctggcggagaacgaggacaaggcggtcatgttctactcgtatcctgatccccgataccgagccaatgccgcctgtcttctgtgttgttacatggtgttgatccagtcgtggcctcctcatttggcattggcaccgattgcacaggcggagcctccgttcatgccgttccgcgacgccggctactcgactgctgacttcattctcaccatccaggacgtggtctacgggtgctggcgggccaaggaaaagggctttttggacctgcgccacttcaatctcgacgagtacgagcagtatgaaaaagtggaccagggcgacttcaacgagctgcctcctcattacattgcgtttgcgtcaccgcagcaggaggactttctcaccccgctggaccacgccttcaacaacgtgctcgactactttgagacccacaacgtgcagctggtggtgcgtctcaactcgattctgtacgacgctcgtcagttcgagcaacgcggaatcaagcacgtggacatgatcttcgacgatggcaccgtgcccaccatggacatggtcaaaaagtttgttggcgcggctgaatgcatcatcgaacagggcggcaagatcgccgttcattgcaaggccggcctgggccgcacggggtgtctgattggcgcccatctcatctactcctacggcttcaccgccgccgaatgtattgcctacatgcggtttctgcggccaggaatggtggtgggcccccaacaacactggctctacctccaccagaacgagttcagagactggaaacgaaccatggtcgtcagcgatacccccagctacaagctggccaacctgcgacccctggtgcccattgccgaccaacagtgcaaattgagacaacaattgagcgctctccaggaccagatccggcgcaaggaggaacaattgggctctctgggagcctccgcagtaacccatgactccattctgccgtcaacccccccgccaaaaacacccgaacgatcaattctcggagacatggaccattgcaactcgattctgccggcccctactcccggacagccccgcaaaaactcccccagtccggcccatcgatctggaagtgtgggcatttccgccatccgtcccaaacggtacatttccacttcccatgacaccgtctacaactcggacgaggaacgagaaggctcgatcgcctcggcgcgacgagtggtcagcagcagacaaatgccgtcgcgtcagccgtcgcggtccgtgtctgtgtcagtctgcgaggacgtagagggctcgctgattgtcacggcctctcattcgccctcccgacgaccctcgcaccagcagcagctgcggtcgccctccaaacagctggacttcgaccaggagaacgacatgaaaaagtcaccattgagggttcggagcgcatcccggcgccaggcatcggtgcgacaagtcagtggcgagaccggcgtgagaaaggtctccagaaccaagaggtcgtagagatttggcggtatttagatgactgcatgatttatccactgagatgacttggtcacatgacccattcaaatgacccaatcacatgacccgatcagatcactttgtcattaacccccctctcacccagaacagctatcggacacactagaatggcatcccacgctaacagataccacagttatatgcatggaacagtatgtatggattaataatgaatcacgtaatggaatggtcgtgtagtggtacactaagagtgcgatacctacgagtactcgtgttctgtggaagtgtggatctccatgccacgaacaacttttagtagtcattgtctcgcttcttcgtctcccggacctccttctcagccagatactgtggttgaatgagatcaacgccgagtcattcagatcttttcagatcgttctcatgctgttcggctaagacccggcctttggagaagggcgtgttcaggggcatgtgtgttctcgtgctcgacgagacggtcaacctgatcgaaggaaaaggataggaagtcggcatcaagtacgagtacaagtactgtacaatactcgtagcgaaagtacctgactctgcggacccaagagttgccacacaccaacaggcagatcgaggtgttgagcagtaccctgcctttgacttgggtatcaccctgtcttcaccatcagacagccctcaagggaagctgatgtgaacggaactggcctcgaactggtcgacgtactgttgaacattagtcgcgtattacttggaccctcaaatatgtgagctgtgtccaactaatgagcaactaatggccgcttatccgctgccccaactagcacatgtcacggcggaaatcgcccattcagctgtcgacagaatttttcattctggttttgcgatgcggtacaaggacatggacacgtgacttcaccattgctcctgtaccccagatggttgtagatgacggagttctggttgtacccatggtggcatctgagcgtatgggtagatgtcagaagagaaaaaatatttaacataaaataaaatataaatacaaatataaatataaatataaaaaacctattctcttacacattactcaagatggtgacacaacggtgacacaactgacacaaacaatgccacaaacagacccaaacgacaccacagatatccccacccacccagtctcagacacagatagatatgacacagataccctcgtcgtcacccgatacgatatgaaaaacagaaactgacacagatacttgtactactatcatgcagtctcggtcacatacacatctccagctgactctgtcggggtaccgcatgcgaccttgatatgatccggttacttgcgctttcctggaactcttgctacgctccagttctgccactttttccagcacggtcccagccaatggtctccatatagtcaccagagcagggtttgatggtgtaggaagtgtgggtggacgagcgttgcgaggtagcggggggcgcgaggggagcgaagggagtgagagtggatgtggaccgttggtttctcacactcggagctccctggccaagtgtgaactcctgtgacctcctactgagtcgcttgcctactctttccgagtggatgccacgcccattcagacttctgtccggcaacccccggttatttcctgggagccgctctggatggctaaagttgatcattagtcagctaataccatacctggttattactcatcaaagttcccaccagctacttgacattgttctgtcttgaggtcctactactgtgcaggtgggatctgacgcccgccagatgtcggaacaagtggtgtgtttgcagttatgagactcttgatctgtcgattgttttgagcaatgtcgaattctcaatctatgacaaaaagcagatttcgttgttttttgttgatttattcttcttttcctttttcttttcttttactgggaattcccaaaaacctcatcacatctccatccaatttaaccgacacaagagagggatatcatgttcgccgcaccccatgttaccctgccgacgaatgtacagtatatgtgcaacgaatattattccaaatggtctgatacggcccgatacgaggttttttttattattattatttaatttttgaggtattttacggggtatttatttgtgaagtggtgatttacagcggaaaaaaaaaagtcgaaaatggggaaggggggtcccagccaaaaaaagagtgccgtctaattggaccaactgaaagtagaaatagaaacacacagccccactgagcttgcgtactggtagccttgcgagtttgtatgtatggtttgtgggatgtgcagatgagatttcatttagtggagttaattaaatcatttaggaaaaggaaaaaatggaggattttttcctctaaaaaagaattaaagaaaaaaacacattggaaaaaaaaagaaaaaaaagaaaaaaaagagaaaaaaaagagaagagaaaaaagaaaagaaaaatcaagatggggataaaatggggtgggtgaatggaaggattggagtcgggtcggtttctgatggtccgattgatgacttgcgagtataagaaggcaacaatctcagcacattgtttagttattgtcctttttatttttttctattttaataggcaaagttccacggtgcggaagaaggacagcaagggagaggcaagcgatggattggaggtagagtattgtctagatacgcgtaaatacactgtaataaatggagggtctctgtgagacaatagggtccgattcaggtcattatgttgaccgtatgtactgttggcaatgaatcgccagcattgacaaaaaaaaaaaaaagccgttggcactgcttataaatcaactgataaaaacccgccggctcagatcaacgaatagtgaataaatcgcctcattctacttactttaaccactcttgactcttcctggatccatttctccccaaacggaagacgcatcgacgatccttgggctcttttggtgggtgggtggagacctggagaacagacctggagcgggaagcctggttcatttgcccgtttcgctcccgcttcgctcccttttctttttctccagagcgcattcgatccgtgagtctaggaaaagggcttagtccatcccgtgatacttgtcccagtgctcagctcggctcatgtctactcagcctcccaatttatatctccgatgaccggtgggctgtgcaataaaactagttggttaaaatcggtcggaaagtggttgaaaatggataaaatacggcaacacacgaatctgcaactggttgctatccttcgataaccgcttcacacgctctccatctcgtcgtatccttgtctctcatttcgcactggatatgcgtcgaaggattgtgtgtataaacagacccttttggaatgtacgtcaccagggtgatagcgaaatagagtttaaacagagtttatgcacgacaaaaagagtttatgctcgatacaaataaggttggactggctgggcagtaacggttcggtttttggtgcggaaaaattgggtccgaagttgggatgagggataaatgagaaaaatagaaatgcgtaaaaaatcccaaaaaaactgggaaaaatgggaaaatgtcggaaaacagcagaaaattgacagagagaaaatggagaattgtcagtaaaaaaatcagacaaatcacgtggccattttcgccccaattagcaccaattagcgcgctatgtctctcccctcttttacccaatatactcatttacctccgtgtaatgagactcagacaagcaaggcaaggaaagagggaagcgcttgagagatgtattgtcgtacaagtcatatgcactttgtgatgaagagcccaaaatggggattggagcgaccgtcggtttgcgccgcggtctccacgggtgccaatggcccgctggatggaccatatctcctccctcaacgacgcgttcgcgcgacggagcccactcaacgcgtataataaaagtctagatggtttggtacattccggcttgttgtgagttttcccttttctccattctgaggaaaaacacagttaaactgggttctgaggttgtatttttttaactggattttatgtatttaatttaatttaatttaatttaatttgatttaatttaattatttatgtttgagagcagcaatggggagtgttgattggagcggggctgagtcagattgagataatgcggttcgatcatcgtctccttctccaaatccaccccaatcgcactatccattgtctctctggaccaagtgactatcacttcgtacaaggcacactgtactacaagtacacttcaagagcatgtacctcccccccgagttttgtaccccttccactttttgaactttggagtggtgaaaccctaatttcgaaaccctctcacacctgccttaaatatctcacggttgctttactacattgttttctatagttactcttgcaccacctcacaccatgaaattctctccacttttgctggcgaccgtgggtctggcccagagcttctattcgcccaccgactcgtacgcgcccgggtcggtcgactgtccctccaactccacccagattgtgcgaaagggcgagggcctttcttcgcaggaacgagagtgggtccagaaccgacacgaacagacccgaccggagctgctcaactacctgaaacgggtgggctttaagtcggtggacccggaccagttcctgggccaggacactaatatcaccatcggactgtccttttctggaggaggatacagagccatgttggcgggagcaggccaatttgcggctctggacgcgcgaacacccaacgccaccgaaccgggccatgtgggaggtctggtccaggccgccacctatctggtgggtctttcgggcggaaactggatggtgggatctgtggtcatcaacaacttcaccaccattcccgacctgcaacactcgtccgacgtgtgggacctggaacactccatgatcaaccccggcggaatcaacatcttcaagaccggctcttattgggacgacatcaacgacgacgtcaacgacaagcagcacgccggatacaacacctctttcaccgacatctggggccgaggtctgtcgtaccagttcttcaacgcttccaacaccgcccgactcacctggtccgagatccagaactacgaccacttcaagaaccactctatgccctaccccattgttgtggccgacggccgagcccccggaacccgaatcatctccggaaactccaccattttcgagctggccccgttcgaggtcggctcctgggaccccaatgtctactcctttgccaagaccgagtggctgggaaccaacatgaccaacggccgacccaacggaacctgtgtgcatggctttgacaacgccggtttcattgtgggaacctcttcttccctgttcaaccagttcattctccagctcaactccaccggagtaaccggagtggtctacgacctggcccactctatcctcaagcgtctggataaggactcggacgatatcgccatctactcgcccaaccccttcaagggcatgtcctacctcggcaactcgtccattgcccaaaccgagtatctggatctggtcgacggaggagaagatggacagaatgtgccctactaccctctgctgcagcccgagagagccgtcgacgtggtcatctcctacgacaactccgccgacaccgactttaactggcccaacggaacctccgctgtccagacataccgacgacagtttgagaaccaggccaatggcaccattttcccctacgtgcccgacgtgaacacattcatcaatgagaacctgacttctcgacccgccttctttggctgtgacgtgcagaacatgacctcgctggacaagaacggttataccgacgtcaactcttccgccgcccttccccctctcattgtctacattgctaactacccctggacctttttctccaacacatcgaccatgtccaagctgtcgtacaacaagaaggaggttgccggcatgatcgagaacggctactccacctccacccagttcaacggaaccgtggaccccgactggcctgtgtgtcttggctgtgctctgctcaagcgagaggccacccgacgaaaccagtctctgggctctgactgtgacaagtgcttctccaagtactgctggaacggaaagactgacgatgatgccgaaaaggctctgaagtttgctcccgccatctatgccaacggccctaacgtttcttccaacgcctcaattggccaggcttcgtccacctccaagcccaagaagaacggcgccgagggtctggttccgggtatggctgccattgccattggttttgccgctcttcttatgtaagcattaatattgactaattgactatataacgagtttcgagcgtcagagagcgtcagcgggcgtactgccacgttccatgtgtacaacaggttgtattacaagtattggtgccgagtcagtctattattgaagctgtagatgataataccagtcattactcagcatgtggagtctgggattgttttttgcacggtttttgcgtctgacagattccaactggcgtcttttgattatttttgattatttttgattatttttgattatttttgattatttttgattatttttgatcttttttattatgatttaatttattatgatttttttaaatcttacagtcgcccattatagtgcggaaaaatgcgcaattggcacggtttgaaacatacggagcgtcgccgcgtacacaaggacgtacagatgcacggcatcagcttacaaacgctgttggcgaccgcagctccggaaatggcgctttttcgaactactttcacgcgtcaacaagttctgtgaaactcaatcgagtcgcgaagtttggaggtggatttggggaagaagaacgctggagatgagcaacggagaccgtccgacggccatcgccatcttccaccagcggtgtattcctccaacccctgaagaatcacattccttccaagctccaatgacgtaaaacggccttggctttgcggccgccgctaggagaccctgaaacctacaaacctgaactagccaaacctagatggcctaaagaggcagacaatgaaaactataatcttcggcggaatcctgcaccgaataatactttcacgcacggaagaatgactgagaaaaaatgatatccgtgagattcgaactcacgcctccgaagagaccaggaaattcgttaaggtattagccttaacctggcgccttagaccgctcggccaggataccggaagttgaaaaagaaggaaaatgggtttacacaattcgaaatatgctataaaaagtctaactaaaacaaattgaggtctagtcgaccaattagtggataaaataggagaaacgaaaaaaaatgaaaaagagagacgaaaaacaagaaaacaacgagagtcgaatcacagactgccacggatctgtactaaaataccacagagagttttccctcgtatctgggacaaacagggtcgattccaggacacatcagttccatgtttgagaaggatcatgataactatgtacaaaatctattcattcagtatgtgactattgatatatatagtcctacttgtggtaaacatcggctccctttcgccatctggcggcaatctcgtccttgggaactcggtcgccccacgaaatcatggaccagaaatgcgactcgttgaatttgggcgcgttaggtgcaacctgcttgacaggccggaaacccatgctggcaagagaagcagcctcgtcagtcagagcccgcttcttctcctgctccttgtagctctccgacttggaaaacacctcccacggccgatccgagtccggcagaggcatccacttgtccaccttccaatgagggctctgggtcatctccttgagtcgagaaacagcccgcttgtaggcaaacttctcgtcctcgccggtaaaggcggtggtgtcagcaaagttggttggcttgatgactcgcttgttctcatcagactctcgctggccagtaggagtgtcgtaggaggaaacgttgggtcgatgggggttctcaatgtcctgaagcgtgtccgagtacatttcctgggcctggatatcagcctcctccttcatcttttcaggatcatcaatctcggggaaaaagagcgagtcggcattagcctctgctcgaatgatgagctgacatcgacactcgtaggcagcatccagcagagtgatgagacgacgggcctcgttcttcttggccagagtcatgacaggcacctcatcgacaatgatggtatggtatctggaagccagagagatgaaatcagcagcagccaggggtcgttcaatcagctggctgaacttgaacatggcaactccgtccttgacccagggaaccacaagaggccgtccatacacaatgatctcctcttccttaccttcagaagaaggacacagagtcttaactgtctcttcccacgccttgtcaccctcgggatcgttgacgtggtacttgacaatgggcttgtctgtaccctctgcagcctcttcttctgaaagcacctctcggtagtcagtgtcactttgcatgttgtgggtgacacatcgggcctgcagaatggtcagaaaactctcaaactgtgtcttggagaagttggtggcatacaggtctttggggagacggttacttgtggccaccagcacgcctccaaacttgaagtagtagatgaagagcgtcttgacaatcttggcggctgccatgtcgggcaacatgaattcgtccagcaatagaacggtgtggttgtcaatcatatcctgggctaattccagcagaatataatctgtcagaagcgcctcagattccttgccaagaagagtctcagcagatcgcagtcggtcttgtcgttcttgggtcaaccgatggatacttccatacagcgacaacatgaagttgttgtaatggattcgcttcttggactggtggggcaacgagtcggcaaacatgtccatcagcatactcttgccacagcccacttctccgtgaatcagcagaccctggggcgagttgaagttgatgagctcctcctcgtcggtcagagtcttgaccatctccatagacttgagatccggcttgtaccacggcctgaccgcctttttcttgatctgcgagttggtcatgtcttccccggccgcctccttctcaatctccaaaagttgcgcctgaagggcagacaccttccgctgaaagtcctgtggaggagtgtagtccttgagccggtggtacagtttctggagctctgccgccacccgcagttgcgcctcatccgccttgagctccccactggccaccttgttctggtagatgtgcagcgggtctgtcagcgccaattgtgagctgtaccggagcgacgagtatctgagcgagctggtgtttcgcagagtcgcgcgcaccaccgccgttcgcccgagagttcttagtcgtaggttcattgtcgtggagcagaaaactgggcgcgttcccggtacttataatgttgtgctggtagagattgagtacctctagcaataggactggcacattatgcacactcaagataaagttccttaaagttcctttctctccactatcttgatcagacagaaaaagcgaccccaaataagtctgcaaaaaagaccgcaaatcgtcgccaagtacggaaaaatgctcaaagtgcccgctccaatcaaaacattcttcgacgcgttcccgctggagaaattgccgccgctggaggtgtcggaaaccgactccaacgcctgccaggtggttggaggcggatcaacacaatccccggacttttacctgtacacgtacggacacaaaaatggtgtgggaacgacgctgagcacggaaccaacatcgctggcggtgcaattgttgctgtcacatttccaccccaagaaatccacacagctcgccacagtatctcacctggccaacatggacggcaaactgcctctattggtccagcagccctccaaccgcacctttctcaccttcaactccatctacaagaacctggtgccattgaccccgcaaatcaacgtgctcagctcgctggtcttccacaacctgtaccatgcgtggatcgtgaccattctggacccagcatactcccggcagtttgaaaacacatttctgagcgtcaagtcactcgagtccaataccgaggcccggttcgtcgagcctctcaaaatcagattcatgcaggatctcatcaccgaccacaagaacctcgccaccgccatggaacagagcacccgactaccaacccggctagtcatgtccatggagtcggtgtacgacagccatcccgagattgaagagatttactgccgggcgcacgacgctctgaccgccttttcgaaactgctggccgaaagcccctcccagttcttcaacgccaaggacaagggctttgagcagagcgaaatcggctctctggactgtgtggtggccgcctttatctactcgctacggcccgagtctccctttggccagactcgcctgggacacatggtccaggatttccccgatctcagcagccatgccgtcagtgttatcgaggaggtctacaagaagaattaatgtacatagatttatacaagcggagagagagcgatatcatcaaaaacatacaagattgaataaatacattattacgtcagtgtcatatacctagagacggatttgcgactgtcggttgttgaggacaatctggagtccgcagaagacaaacaggatgatgtacaccagcacggcgctgaagatggtcgatgcgacactgtgttagagagagagagagagagagagagagagagagagagagagagagagagagagagggaggagagctggagggaacaagacaatcaagcaagtgacatgagataacgagaaactgaagcgtgacgaatggaggacagcaagtattggtactgtagaacagtgttgcgctgatcaagcagcaagaagagtcctccaattggacgttttcgacgttgaaaggattcatccagtcggcgtatgagttgtctgtgttgtcatcaaagatcttatgtgtccttcatgtcgtcgtcaatgtcatacgtgctctcgtgttgttgtcgatatcgtcatcctgtgtcgtcgtctacgtcatccatgcttgtagccatgcttgtagcaacgacaattccccataaaaaaaccacgatactcacgctgcaccatcctttgggtcattgatggatccgaccatggattcgctgccgctcttgaacagcaggcccagcacgccgagaatgacgatgccaaatgcagaaataacggtacaaaaccaagcttttccgggctgtgttagttgttgagttaccgataacacccccccctgttctccatcatactcactgccacgactgccttcattgtgatgttttcggggttgttgctctggaggcctgtgcgtcactctatctgtggtaatagtgatatcgtcgactgggagcgaactttattgcaccagggagtgaaacatagcccttgggatttggtgtaacgagtagaaaagggttgacgagagggaaacagacgcggtatatatgtacttttttattgtggtgacaccgccaatgtcgtgacttgacattttaacgacaagagaaaaagacatttatcctgacacgtaacagctctcggagctactacaagttgtactggctctatcgttcacgtgatcaaaccttaaacaaggagagacacgcatatcacatctgtcgctacatctaaacaaaagacattcatcacatttcacaatggtcgaagtttcgcttactgtcggcaaattggacgcctctctggcgctgctgctcaccaaggaccaccatctcatcgaattccccacaattctgcttcccgacgacgccgaggccggctcggtggtgaagatcacctgtgagaaggactctggagcggagaaggaggaagaagacagctttcagagcctgcaaaaggagctgctggaaacgtacggcacggagcagcccaaggcgccagttctgagcgcgaaaaacatcacccagacgtctgtggtgctggaatgggagcctattgaaatcgcccaggccgatatcaagaaactggtgctgcttcgagatggcgtttggtgcggccacattcccaacccactggtgcgaaccgccaccaagctgtctggctttggagtcgagaagaagtacaccttccagctggttttgtacaccacagcaggcacctacgagtcaaatctgctggaaattgagacccatagcatgaccgacctgcgaggtatcactgtgtgcttgggcgaaatcgatcccaacatgacaacggtcaccgagtctgaaatctccgagtctctggaggacattcacgccaagcctctgcaaaatgaagtcaagctcgataccacccatttcgtgtgcaccaagccccagggagcccaatgggagaaggccgtcgacatgaacattcctgttgttttgcctgagtggctccgagcctgcaaaatggacaagaagatggtcaacgtcagaaacttctacctggactctgatcccaagcacagatcccagtacaaacgagctcctggcgcccccgcctctccttccattcaccaggctgagtccatcaggtccactgagcctgctgcttctgctcctgagtctgctcctgttgagtctgctccagtcgaatctacttctgtcgagtctacttctgtcgaatctactcctgctgctgctgcgcctgtcgagtccactgctaccaattcctatcttgagagatccaacactcgacattccatcttcaccgagggcgctaccgaggccgaggaggtggacgaggaccctctcaacgttgagctcgaaaaggaggttgccgccaacgacgctgaagtcgaggctgcctccgagtcaatggccgaggtcgatctagatggtcccagtggagagcctgacccagacaccgtcgaggagattgccgttaccgagtctgatcctgttgtcgttgccgaacccgaacctgaacccgaagttgaggccgagaccaaggccgaggacaaggtcaaggagccagaagaagcagttaccactgatgccattgagcccgagaccaagactgtaattgacctcactggagatgacaagcccaccgagcctgagactgagcctgagcctgagcctgaatctgagaaccagactgaacctgaatccaaaactacacccgccgaagagactaaacccgagcctgaaaccgtcaagtcaccctctcaactcgctgacgaatttgccgaagtgtctctggaagactcaaagtcgcctgaggacagcactgctgagggaggcaacaaggaggacgatgatgatggagatgaggacggggacgaggaagaggaagtggacgataaacaggaggactcgaagcccgcagctgcatctggcaagaagaacaagaagaagaacaagaagaagggcaagaagtagactaacatggtctaatgaagcgcatggatgtttgactaatgcactaatggttagtaaacaaggatattaccatgatattaccatgatatttttcccgaatgatatacaacaacgatttaaattgatgaagatggcttacaatatctacagtataatgtacttatactcctatcagagtaactacgcagcaacctggcgccagggctggtttgccagcattcacaataaattagtctagttgtcaccaaacagacgtcggactcgtcgcagaaccgagtccttctcgggcacgtaggggtggtccttggaggggatctccagcagcgcagggaaggcctgtgtgtatgtgtcaactcggaagcggatcttgtcggcaatatgctggttgatgagcagaatggcaatgtccttgcgggtgttggtgaactcgtcgaacgccttctcgatggcttcgttttcggttttggcgtccaccacgaagaagttcttcttcttttccgcgtcgtcagacacattgccgattcccgccagcagcaggcccgtcacggaatcctcgtcgccaatcacggcaagaaactctcggtctttttgtgtggttgccctgggttagtctggcgtccaaattgcggtcgtcgcgggcgtggctgcgatactcacatggtgtgtggtggtggtgtcgatgcaatgtcaatgtgtcgtcgagatgatgtgcgtgatgtacgtatagttgtgaaagttggcttagtcagggggtgcgggaaggcaagcaggaaaagtggataaaggcggagagaagaaaaacggaagaaaaagatgaacctccaagctattctttgggtgtatattttgatctgagtgtatagtcgaccttgtgaactacagtatttaccaatggtacgagtatgtacgagtgcacttacagtaacacttgtagttggtttggatgtgcctagaagccaattacgaacaagtggagagagaaacaactatttaaccgggcataaattcctttttaaatcgattgattgtctttgggcacttttatttccaccacaacagaccattgcggcgcactcatgctgactgttgttctaattagttgggtatattaagtacaggagacagatagatggctttcttaagtaaaatgaagatctgcactcaagtgtttgtgttgtgtgggttcgaaccccacagacaggaaagaaaaagaagaaaaaagatcattcaaatagtgattgaccccgatgtcccgactcgtttgacaatcaaatgagttttgttttcctctcgtttttttcctctcgttttttctcattttttcaaaatttccatttttccccatttttcccttatttttctgattacccaattttcaattttcaattttcaattttcaattttcaattttcaattttcaatttttgttctaagcaaaccccgaattaaacctatctagacctaccgaaagtagtcgacgatcccacaataattcaacaccaatacatataactcattgccctgcctctccttatatctctcataacgtgacgtcggttttttagccggcaaacgctacgccctccaaatcacactacttggctgacatgtgtactgctgaatatgcagtgcttccaaaccttcggattcaccattttttccgcacaccaccaacgcctgatctatcatgtcgcttctccgtctgcaatccgtgtctgcgcgcgccttctccacgtcggcacagtgtctcaagggccactccaagtggcagaacatccggcacaccaaggccaagcaggacgccatcaagggcaacctagccaccaagtttggcaaccagattgcaaccgcagccaagatgggcggggccgatcccgccggcaacatccgactggcaactatcatcgacgccgccaagtcgtacaacgtgcccaaaaagaccattgacgcggcgattcggcggggagccggactggacgccaaagacaagcagatcgaacaggttttctacgagggcatcgggccgtcgggggtgtcgctcatcatcgagtgtctcacatccaaccgaaacggcctgctggccagcctcaacacgcccttcaaccgagccgcgggcaaaaactcgggaatcgccttcccttccacagtccagtttctcttcacccgaaagggctgcatcaccattgagaaggaacaaaagtccatggtggcgccggacccggctaaccccatgaagaagatcgagcaagtgacggtgctcgactttgaccacgtcatggaccaggccattgagtggggcgccgaagacgtggaggaagatgtcgaccaggacggaaaggtggtctcctacacgctctacaccgacgtgcaggacactggagccgtggccaagctggtgcaggaaagtggcattgccgtggccgacttctccatctcctacattcccaacgaagataccatggtggacattgaggacgaacacaaggccggcgttttccaggccttcatcgactccctcgaggagattgacgacgtgacagagatctacaccaacgccagataatgtacatagctaacgtggcgaatattgaggttgaactagctgaatgagcaactgagcgaatcggagtcgcagagcagatcggagtcattgactagagcgaatccgagactcagacgggggaagtcgatgataccaacacactcgcacatagcatacctactgaagcgtagttcacatccttgtagcccttacctcccgaactacaagtagccttatattctgtaataatatcaaaccaagtggtcgccaggatgtaattatgatgattatgacacaagcgtcccgcggctatgaaggtactggtggcaagatcacatttcaatcacactcacgtccacaccatccaacaattatgattaagcatacacctataaatacaatctgaatgtggccatccaccgcctatactccagcatccctctactccctctgaacgtagtgaggaagtccatcttctccaatgatggtggaatactcggatgtgccggcagactcgtgggggcccgaatgggtacctccatgccccacatgaccatgatgtcctcctcctactcctccttgatacaccggctgaggcgccatgccgggtttggccagactcagaggcggcggaaccttgccctttttagtgatgccgttgcgagccagagaagccgccaacgacgtgtttctgtatgacttgggcacctcggaaaccggaggacccgactgcaacatgtacgactcgttgttttcgtcgtgcacagaggcaggcacagaaatagacgcagaatccgactgtgtgatgttgtttggggggccgtcggagtctggcttttcaaaaagaccactcttggcccgcttgacgccccgctcgtctcgctcaaactctgaactcgtccgtttcttggactcggattcgtccgaagagtcgtggatcgactgctgggactgtgaggaaggaggtagagccggctgctggggtccctggccatctttgccttccacaaagtcccagaatagcggcgtcttgatcaccatgttctgccggtagtccgttccatggatcaccttgccgttgatgatgtacgtctggtgctccagctcgtagtccgggtagtccgggatgattgatgatgggtactgcttgttgttaggtgccgctgaggcgttggaacccggatgtgcagcctgtgtcgagggcgtcggttggccctgctgctgtgacatcagagccgtggcggcgttcatactctgatcaaacgggaaagccgcatatgtcgccgacaaaggggcctgctcatacagcgagtccagatacggcatatccatggggtttgaaggtgggaagtagtcgagcgggaaatcggaagattgagaatcgtcgttttcgtccttgatcttttggggtagctgctgctgctgcgggagttgttgctgagactgagcgtgctgcggattctgaggattctgaggatgcggcggatgcgactgctggccatgcaaaatggacccgcctagctgcaccatctgattatactcggggttgctggccatctgctgctggttgagctggatctggttctgcagctgctgctgcatggatgtgaggtactctgttggcgtgctcaggtaatcgctcagtgcatacgcactctggttggccaccgtctgagatgcaatctgcccagtggggccgccaccctgggtttggccctccggaggcgcagagtcggtcactataccacctggaccactgcctggagcatcacctgggcctcctgcacctccaactccactggcggaaggtcccgcctgttgtccactatgtcctcctccgggaagagagcccaccgctggcatcccgtctccgttggtcaccttcataagctgctcatagagactttcgttgagatcaaagttgaagctcttagcgggctcggcgtgagcttcggtcgtgggttctaggttgttaagctcccgtcgcatgtctcgttccagagcatcgacgaacagccggtcgtggggcacgctgaaccagtagtagaccttttgtttcttttgtgttcgaatgcagctgtttttgtacagaaactcgaggaacggcgatttgggcgactcgagcacggcgtcgctgttgcacttgagaccgcgcagatcggagaaaatgccctcttcgaactttttgcggttttttatcgaccgtccaaacgcctcgaaccggaagctgatgcatcgaacaatgtctgttcctgtgatatgatagaggcccttccagagcacgcagctgatgaactcctcggtgggcaggtagtagcgccggataatttggcccggctgccagtttgccggtgcggtcgccagaaaaaatttcactaggttagtatttcacaagaatggccttgagagagtgtcacaataccccgatttccctcaataatcccgcctcttccaattgtggtggtccgttgcaaccgcgtgcaacctgtcacagggtctgtttcatacatgtaacagcctgggttgggagtcatcacacgtgtctggggggtatggtaatggctgagggaggtgtatctgggcttaccaacaccctgttccggtctccatgccgtccccatcacttgcaagtcgtcaggcaccaccgtcgagcacaaacgcgtgcccggatcccatacctctctctccctctctctactactgctactcactgtcgtcgacctgagcaagggcatcgcgtgccagctggggcagcatatctctgattgaagacatgtcgaaatgtccgtagttaccagtcgtgtgcttgtggcatatatgtgtaaagtggccgcgcaaaggagtcgtgtggcggctgtgagtgtgtttgtttcactggagccgagtgtgggtcgttgcgtgctggggagggtgtgtatgtgtgtgtgtgtgtgtgtgtgtgtgtgtgtgtgtgtgtgtgtgtgcgtgagtggattgctgtggcctgggtccgccggaaaagggagagaggtcgcaatacgtggatcggaggagctcggctcttgtcgtgcttagcagatagtgaaaacgacgatctttggagagtagatttgtcttttggccaagattgcccatttgagttcaccactacagtagagttttggcatctggcattttggttttggttttggttttggtttggtttggtttttttttttggagaagggccacaccaccacccaccataaccggacctaccccaagtacattcggttcggtacagtatggtacggtacgataccggtatgatgcgaggagagcaccacacccgcaagacgcccgcagctttgtggcaagttaaaagacagccacccccgacgttaccacacaccgctgttggctggtcgctttctccggactctccgagctctccgggtcccctgacacgctctctttctcgacagggacgggtagacgtactcgtactacaagtaactatctgtgctccttcttcggaccaactaccacacaccgtgggttgcagttgatggaaaggtctagatttcccgccatttcccggccatttcccgccatttccagcccatttcccgtccatgtgatggatgcttgtgcgagcaacaacttggtctttgtgttgggtctgtgtgtgtgtgtgtgtgtgtgtgtgtgtgtggctacagtgcagtgtgtgcggggggattggccctgaagtgggatgtgggattggaggtcgccattacagagtacaggtacgcgcgtcgtcgcgtgcgaaactcccgtcaaagttcaagaaaacacacctctgaagcgttgccttcttttgttgggtttgtttgtctggtttttccgttactaacctgtagctacagtacaagtaccggcacagtcgtatcgtacaaccgtactttagcgtcagtctccgtcccacataacgtataccccttcttctgtcccttcggactagcattgggttttgggcgcttagcgtttgagctaaccttgtggctgcatctgttttgaaaccagcgtttcttgtttgaggattgcagagcttgttacagagtcgatgggggcggagagaggcggccaattgtggcgggttagggccgatcaaacgacgattggacacggagatgcccattccgcacatgtcgcaagagggctcttgaccatctaacatcatctcctccacatcacgtgaagtctcccggccgaacagaccagaccacccccctcctccattcctcgtatctatttcggggcttgctcttagcctttcaatgctgtgtccacctgcagtacctaaaccatgcagcgaaggtggactactgagagcaagagagggcaaaaaccagcacagacgtgtgttgctaggtgagactaatagccgagcgagcgtgaatagcaaaagggagaaaaatcaagacgaagaaagacgtcttctactgattggtcgtcatatgccctgctctcagggagtgagtacatctattgtacatactcgacgactacattctgtgctactaccaggggtatgtgcccggatcagagcactagactgtggacaaagaccagcccacgtccgatcgcacagctgacttgcaccactcggagcggtaaagtccatggactttggctcttcctggttgtactacttctaaccgcttgggggcccggggagatcggcccaaaacggcaactgcaactctcgtattctcttattccctgggatgtggggccagcgggcgtcggccaaatacctcttgcggacactcttccggggacgggtggggttcttccatccttccccagtccccggaactatgtcgagagtgaagagagagtgcgcaacacagtactcccgccgctgtaagctgtgactaccctgcatggatgttcggtgcttggatgctgtggagtcgcgactgtgctttccgaaacacgtccaacaacagcagcagtgcgtggcaccctcgtcttggcttctgccgccacagctgcacgcactgtgctgctatatcacaagcggcggcgggggtaagacttgatttgggtaccaccggctactgtacggggggtttcggtgtctggtctcttgtctgtctcacccatcatctatcataccgttcgtgtatcctatagatgagatgggataactgcaaacctccaatgagcaagaccccatatcttacgtcaaggcaatctagcactaatgaattgctgccaacgcacacaacacgctaggaccaaacggtaacactactaattacttcgatggaccctttagaccccccatctacatgcttagacacgctctagttccactttagcacgcactattttggacattatgcgcactaccgacgatgatcaggccacaatttttccagcgtgggaactcgagggaggtttcccaaccattctaccagtagtaattctgctactgtagccaacagctagagtcttatttgtttcacacccgttctctatgcaaaaggtggtggtgaagagattgcacaggagcttagacaagctcttcatctgtcggcaaaacctattcaatccatagtgatggtgcattctacagcagaactgtcggtcagacattaaatggtacctgcaattcactcgacgcagaattctggcccgagctcttggtcaggttctctcaaagccgcgcaaatgaaaccaatatgttacaagttggtcactagctgtgcgcccagagttttctttttcctatacgactctgagagaacctgactaaagagcccaaccgtatccacagcggcagtagcagaggcaagtggagttttgtttgatctctgcaagttgcgctcttgagaacctcgagttggaaccacgagttggaaccgcgagttggaaaccacgagttgaatccgacgagcagcaacgctatatcaatatcaccagacaacgacgggaatgagccatgtgaagaaatagtgcgccactctccaatgatctattagttctattagtgtaacatgtaccggtacatagcggtagaatccaattgcaaatgcatcacttgcgcttaagtccacgtctagctacccaagcctcggaaccaactccgctgttcacgtcgaaagagacgtaggcctgttctccaccctttcgagagtcccacagctcgtagacaggcaggggaatacgtcctcggaccagcacaatggccttatcggctgcaagctgcgcgttgagcagagatgctgatacaggggtatgcaaacggacgctagctcctgcaaattgcaccatggcctgtccaagacactcgccctgcggaatgtcaaagttgggcaggtactggagtccgtcgggggtgatttccgcgtgcttgacggtcttcttgtccatcgtcatgacggccaaaagagtggagttggtagacagtgccacatcggccagatcaacgccctcagagtcgagaataccaacgtaaacagactccagacccacctcgagggccgggaggtcgctcaaatgagacgcaagattgcctccgtgcagatacgtgacagtctggagcgagtgttgttctgcacctgtgaaacgtggaggctctgcatctggagcatcgagaacgtgcgatcgggccttgacggattcagccagtcgcgcctggtcggcgtcgacgccgggatcacgtgtaaacaccacgtctgacggtttcacatgatctatgagctgtcgcagaagatcgtgtcccgcagcacgcacccagccgcaggtattgaacaccaggggcagcttgagacccttggcgaagtcgataactgccttacacgcctcaatgtaccccctggtgtcatctttggggttgttgtaacccacaaaccgactgtaggtgggggctgtaacgtgtgtgaaggagggtcccagaatggaatagggactaaggtgacctgcgccaataacagtcacagacacctgaccgggggcagtgaactcgcaattgctaggatctagatccacaaacgccacagaggtgccggtctttttggtggtcatgaacgcactcaagtatttacaaaaggtggacttgccggtgttttgagagcccactaccatggtggaggagtgcttgagtcgccgaatgtcgtcacacacttcggcccattcgtcatagatgccgggaatgaccgctgcctgcgatttcgtcactacactggctgtgttgtagattctgctgtagttgctgccgtcatcctcagagcagtgccacaattgacgcacaaacggcacaatgttgcccgaggacatcttcccaaagttgctgaccgtaatcaacgggttttctgaccgtcgcggcattgctgcgatctccacaatgaccgaggatccctccaattgatgcaatgcctccatgacgtcttcgtcccccgattctcgagtttcgggagctccagcagcagcctcgatttgaggaagagcgtgagacgcgggcgcaaacacgggaatatcgaccggagagttgatgttcaccagagctccgttgatatggataactccactccacaccgtgactacataggctccccgtagaacgatggtttctttgaatttcatgccgtggaaaactcgcgatcgaccgcgagtctcatctcgtaccaccttggtgttctttgcactgaaatcaaaagtgctgagctgtctgacggcctcatcttcttcggtgatgctgatgaacgactcctctgcatccggagagtccagaggagggttggtgaccacaacgacttcgggatccgaatcctccgagctgatgacctgttttttcgtcggcttcagcgcactcaacgcacttttccgcttcgtcatggtggctttgaaaagatttcaactacccagtgttttttctcacatacatgcacatgcataataattttcgaatagagtttggggggggggggggggggaagaggagcggattatacgaatgatattgggggtgattttgggggcgatttcgtgtgacaaacatgaaatatcattgcattaaaccgctaacaatgttgtcatatccattgtgtcaaaattacaactccgtcggatcatttttgagcgtactacattgtgttctctagacccctacttttcccaaaccaatgatacaaatctataatgctagttatttactgcttgcctcgcttcttgttgagcacctgcttcatctcctcctcgtccgagtcaggcagagcaatctcgttctcgtcctcgtcctcttcgtcactgtcttcgtcctcgtcctcgtcctcatcatcctcaccttcgtccccctcacccatctcgacatcgtcatcatcgcccatggccatgatctcggacatgtcgtcttcctcatcgtcttcgtcaatgtcctcttcgccctcgacaaactcgacctcggagtcggactcctcgtcgtcgtcgttggcgccgtggctggcgtttcgcagttccatctgggcctcaagcatctccagacggccctccagagccagcagacgatccagtgtgttgactcgggtattaagagccttgtgaagtcgcgacacagtcaccagcagcttgggcacggtcaccaggtatcctccatgtgccaccatgacccacttgatccaggcgttgaactgtcggcctctagagggttgggcggtcatcttggcagccaaacgctccaaaagtagcacggccagattactgttgagtcgctggacggtagacttgatgccctcctcgtctcggaaaaggagacacgactcgagcagatcgtcgtcgtcggacttgatggcctgggtaagaacagtggatagagatcccatggtcgggggagcagttccggaaagtccgctcttggtggtcttgttttctcgcttgagagcgtccatcttttcggccagagtggcagactcgtcgtcatcggactcgtcgcttcctacaccgttctccagctgtgaatagtcgtctccagcagcaatgatagcgtcctcctcgttgtaggacacgggcacggttcgctcctcggtgtagtggtttgcggcgtttttggggtcgtgcaccaccgtcatggtgggctcggtctccagggcagacagagtcacgtgtgcaaactgggcctgggcccgctcggtgtacgagtagtaggcctccttggcggtgagcgcgatggcgtcgatgacgaggttctggccggcagccttagtgccccgttccaggtccagcgatgcaaacgaggacttggtgacaatgctcttgcgctttcccttcttgctgttgggggtggatccgttagtctgggcgagctggaagaactcggcggctcctccctctgtcagggcggtgagaatgtcgccgttcatggagacacggtgggcacccgactcggccatgagcaccagcacaattttcttctgagccacgttaaccacgttgatgagacggtcgccagcaacggcagcaacaaggtcacctcgaacacacagctcggtgacagtagaggtgtgcgaggggatatcaaacagagccgagtcaaacgagacggccgacgagtcatccccccgggggccgtagacggcgatgttgtgggtggccagcagcacgttacccgagggcagaacggccaccagcttggcgccggtcttgtccacagatcgctccacagaagagcccttccacacgttcaaaagacctcggttgtcaagagagtaggtggtgccggagttggcgtcgacgtcaaagtcggccacaggcagagaatggccgcctcggagagcagacacaagcttggcctgggcgggagaaaaagtgagaatgtcgccccggttggttcccacagaaactagatattcctcggaagaagcagccgccgagtcctgggtcttggtcttcttgcgtcgagaagacgacgaggcgccctcgccaacgttcttggtccacttgagagcagtcacagtggtgcccttctccaacacaaactccacgggctggagactggcattggcgcctgagaccgcctggacacggatcttgtgctggttaagcgcactagtgacgctggcgtactgcgtgagagcgggatcgaatcgagacagctgttccgacatgatgtgtgtgagttgtggtggaattatctggcttgcctgatggttgtccaagtgcaggaaaaaataatttaaactctgaattttttttctgcatgaaaattgaccgagacttgtattgtaacaagtacatctggtgtggtagaagaacagagcagagagcgttggagttgcggggaagcgtggaaacggggagttttggggggttccgactcttcggtgtcgacccgaaacgtgctcgacacaaaatatctcctcgtatttgccactatatgtcattctcgatgatccaccgtaaacgaggttactttagcatcacaacggggaatcgaactggcgcgctgtcgaacggtagaggagttggcaggcggcgttggttcgattttgacctgtgcccggaatgggaaacatttagttgtcgtgtaaatcctccaagacgagacggtcgcaacaaaccaactcaaccatagtacaccattgtacaggagctgtacagtagctacacgcccataacgatcccaccaataccagattgactcatgcactagggttagtcaccgacaacacataatctgtttgtctccaaatgctcaacgaaataccacactttggaccaaaccggtccgatagtcgtgataaacacccccggtttactcactagccgaaaaactggaccccttgcaagtatttgttggcgttttaacagctatgtaaccccgatggtctaaactgagcttgttcattgtcaccaatgttgtggttcggagtgcaacggaacaacccaaagtcggttcttgtcgccaacagccggctgttccctccttggtctcccccctccctccccgcccccacaaaattgctctgcgacgtctcattgagtctgagctacgtctcattgagtctgagctacgtctcatcgagtgtttgccgtcacgtgacgggctccaaaaaaaaggtttctctttgagttcccgcattttaagctcattctggaaccttaaacggggtagtagttggatgatggatgagaatgaattgactgacaaacttgtacgtgttttgagggaacagggttggttgcccaaaggcaccaaaatcaacagattaagagtgggaaatacaattcttggggcgtggctctggggggggtatgtaggatcacgtgacctggctggatcggtggcgccgttctcccagtgcgacttgcactttcctgtagggtggctatcactgtttacgactcttgaactctatctttgggagctcgaaaaatatataaacatgcataaagcatacaaggcgcgtaagagcgacgagtccaccacggcacaaccacacgtttaccacaacatacacgcagtgaaatgagcgacagagaaacttcagggaatgacgacctttcgttgcccaagggtgagtagagccggagggggggttgtgtttgtgtttgtgtttctgtttgtggggggttgaaagttgtgggtcggttattaacccagccacggtgcagaagatagtgagcgaaatcattccgtcagacctggcgtttgccaaggacacccgcgacgtgttgatcgagtgctgcatcgagttcatcatgatgctgagcaccgaaagcaacgagattgccgagaaggagagcaagaagacgattgcgccggaacatgtcatcaaggctctgcaggagctgggattcatagactacattgagcccatcaaggacctgattgtggagcacaaggaggcgctcaagtcgcgggagaagaaggttggaaagctggagcagtcgggcatgaccgaggaggagctgttgagaaagcaggaggaaatgtttgctgccgccagaagcaagctcaacaacaacgcatagggtgggggagggggacaatgaggtggcgacaccaaacggttggataatgggataatgggataaatgggctggttaggacaatgtgtgctacatacaggatagtctacgtgtggtcgatgtgacgacagttgcatccacgaaacgtactaattgatactgtggtgttggctctatgtcaacatcttttggcatggtgatctagagtagcggccgagccggttccgcgggtgtatatagatgtatcatatttgatttgcataggcaccttttggattggattggattggattggatttcaccaagaccagtccttttttttttttttttttttttttttttttttttttttttttgagaaaacaaaaagggaaaatattttttttcttctgcatttatttccaaaaaaactcggctgatgaacaaatagttgagtttacagttgagatatacttgacaaaaacattgtttttggcctcgatctgagacacgctacaactcggcgagcatcgatattttcacagattggaccctgtacatataagcacagtaccaacagcccctctgacacctctcaagcatttgtagctcttttcaaccagccattttagcacatgtctgtgtctgcgactttggtttcttttctgaaaaactattgcaacttcttgggcaacagcaagcagtgaccgcgaaaatgcacgtataacaaagggtacaggagtccaaatctattttttgaaagtaaaaaataaaatgccagactcgtgtgtatccgacgatacagctctcgcgccctgtgcattgtattatatgtttctacagccaaaccaaaagtgccccagcagcctacattgaatttcccttgatgcgttaccctaccttcaacgctaaggttaacgtaacccatcaaaatatagggaggtatggaaaaaaaaaaaggtagcattacattgcaccgagtgtccacgctatctgagaacgacaaatacagcaagatggacacaaacgcgctgtactcgtgcttcgaggccaccaccaacggcaaccccaacaccatcaagcaggccgaggcccagctcaaggaggtggacaagatgcccggcttcatccacagctgtctggacattgttcgggagccccaggcgtcggacaatgtgcgcaaggccgcctcggtctatctcaagaacatggtcactcgaaactggaacccccacacctcttccaagaagctgatccgggtcgaggagaagcccgagttccgggagaagctggtgcctactcttgtatctgtgtccggggctgagggcgtcaattcgctgctgcgatctcagctggtggccatgctggcatacattgtcgtgctggactaccccaaggactggccatctctgctgggccaggctgagcagctgcttcagagcgagtcggaccaggacaaattcaccggcgtgctgatcctcaccgaagtcaccaagcgataccgatacaccaccggcgagagccgagcgcacctcaacgagatcatcacacgcactttccccacgttgctgctgtttggccaatcgctggtgaatcaggactcgtactacgctggcgacatgctgcgacacattcttaaaatgtacaagtacgccacctactacaagctgcccgtggagctgcagggcgacgattctctgcggccctgggccgagctgcatctcaacgccatcacccgaaccctgccccaggaggtactggctctggacgtggaggaccgtgagctgcatccctggacaaagtgccagaagtggggctacgccaacctctaccgaatctaccaccgatacggcgccgagtcggtcgtggccgccgagtacgaggccttcagcgcccgattcaactctcagtacgtgcccgagattctgcgggcctacttccagcgcatcgagggctgggccaagggtgagatctggatctccggcaagtcgctctacaagctcgtctactttctggaggactgcatccgagtcaaggagaactggcacttgatccaggaccacattgacactattgtgcgtcacgtggtcttcccgctgctgtgtctgactgagaacgacctcgaggcgtttgaggacgagcccgtggagtacattcatcgacgaatcgatgtctacgacgaaaaccccaccgccgacatggccgccacctctttcctcatcaccctggtcgagaagcggccctcctgtctgccttctgtgctgcagctggtccaggagacagtgcaggccaactctggcaacggagagctcgagctcgccattaagcgtgagtctgcgctgcgaatgttgggtgccatctcccatctcattatcatgaagaagaagaatgcccagttccgaaccatgatcgagccattcctcatggagtacgtggtgcccgatttcacctccccccacggctttatgcgagcacgagcctgcgagatggtcaactcgtacgccgacattgagttccagaaccaggacacggtgcgaactctctacagcaaggtgctggtctgtctgcaggaccagcacctgcctgtgcgagccgaggctgctctggctctgcagcctctgatccagattgacgacgtgcgtgtggcgctggcagacaacatcaccgccatcatgcagcagctgctggagctgtccaacgagattgagctggatgccatctcggccgtcatggagaactttgtggactccttctccgagcagctggcgcccttcgctgttcagctcgccacccagctgcgagaccagtttatgcgaatcgcccaggagctgtgtgagaagaagaaccccgacccggatgccgacgacaactttgatttctacgccgacgaagacaagactctggctgccgagggtattctcaacaccatcattaccctcatcatggccatggacaactccgtggagtccatctatgccattgaggaggtgctgatgcccgtgtacaagctggttctggagcagggtctggtcgagttcctggccgccattctcgagctcattgaggataccaccttctgcacaaagtccatctcgcccaacatgtgggccatctttgcggtgctgtcggatacgtttgtggagcacgccatggacttcattgaggaattgcagcccgtgttggagaactacatgaactacggtgccgaccagctcaagcagaaccccaccttcattgccaagatctggcacatcatcgagtctgttctcaccgaaaatgagggccggctgtcctggcaggaaaaggtgtacgcctgtcgacttattcaggctctcgtgctcaacttccacggccacgtggacgagtacgtggagcgaatcgtcaagcacaccgtgtcgattctggttgccgagcctaaccccgaggagcccatgaagcccgtcttccgtctgcatttgattgagaacattctgtcgtgtctcatctacaaccccgtggccaccattggcctcctggagcaggtcaacttcactgcgcccttcttctccatgtggttcgagaacatggagcagttcacccgagtcaacgacaagaagctcatttgtcttgctctgctagcagtgatcaacaacgctgctgctctgcccgaggctctgcagcagaaccttccctctctgttccagggactggtgtctgtcatgggcactcttcccgctgctgagaagcacaaggaggaggtgtccaaggagttcgatcccaccctcggctcagatctggctgcatacactggcgagcactttgactatgacgacgaggaggacttcaaccccgctgacctgcccgagggcgaagaggaggacgaggaggatgaggacgaggcctatgccaagctgttgcagtcggagagcattctcagtggcggcttccgattcgacgacggagataccgtggaagaggagggtctggtggacaaccccaccgacagcgtcaacatgtacgcgcagttcaagcagcaggtggaggcgctctcacagagcaactctggattgtaccagactctggtatcttctcttactcctgaccaggtcaaggttgttgagaacatgtaccagcgagccgaccaagctcctcgacagtaaacagtcaaggtgaaaaatagagcactgatcacagtggtagatagttaacagaagaatgaagtatgtatgggcaatgagccacgtggttgtaaatcagacaatatcacgtgtcgaggaacaatagtacgagtactggcagtctatgctgtctggataggccgatactgctttgattctactgtacagttttttaccaactaagtctaagtaattttggagactctttaatcacaaaactgatgttcctcgacacaagttgcaacttgcaatacagtccctcatactctttacagctgtcttttcaaatactgtcttcactatatagaaatgttgaattcataaataacttcctctcagccacttaaacgggcagagggaactggccggcccagttggagatctcggtcttgagagcctcgatcttggggttgccaccagcctgggcagcagccttgaagtccttgagcttgttggcctccttgggcagtccctgctggatctcaatggcgagatcgacggcttgcgagatgtagttggcaatcttcttgaagtcctcctcgccgaagcctcgggtggacatggcgggagcaccgattcggacaccaccggggacaagggcagacttgtcaccggggatggagttcttgttgagagcaatgttgatctgctcgcaaacagtctcgactcgagcaccgtcaatgcccttgtctcgcagggaaaccagaaccatgtgggagtcggttccgccggacacgaggttgtaaccgagcttgttgaactcggtctccagagccttggcgttcttgagaacctgctcctggtactcccggaaagtggggtcagcagcctgcttcagggcaacggccagagcggtgatggtgtggttgtggggacctccctggtggccggggaagacggaaaagttgatggggttctcaaggtcgtagagaatctccttaccagtcttggggtcgacggatcggacacctcgtcggaaaaagatcatggcacctcgggggcctcgcagagacttgtgggtggtggtggtgacaatgtcagcgtactcaaagggagaggggatgacaccggcggcgatcaggccggaaatatgggccatgtcgacaacgaggtaagcgccaaccttgtcggcaatctctcgcattcgcttgtagtcaatgagtcggcagtaagcggaggttccggcaaccagaaccttgggtcgatagaggatggcggtcttctcgagcatgtcgtagtcgatgatgccggtctcgaggtcgactcggtagggcatggtctcgaagtaggtggagacggcggagatctttcggttgtcggtctggtaaccgtgagaaagatggcctccgtggggcagatcaagacccatgagtcgatcgtggggcttcatgatggcctgatagacctggaggtttgcgggagagccagacagggtctggacgttgacgccccacttgtcgggggtgacgccgaaggccttgagggctcggttctggcacagagtctcgattcggtcaatgtgctggttaccaccgtagtatcgggcgccggggtatccctcggagtacttgttgcacatgggagatccaagggcgtcgaaaacagacttggaggtgaagttttcggaggcaatgaggacgatggagtgcttctgtcggtcaatctcgtccttcatgatgccctcgacctcggggtcgaggtcgtggagggaggcttcaatgagctgggttagtatgggtcattgagcgtgcgtcgcacttgtccagtcattacactgtgtgtgtgttgaggatatggcgtgagtgtatatttaagaaacgccccacagccggaacacagacgttaccagacattatcgcacctctacaggcaccttcatagcatcaaccaattggtcacaaaacacaattgcaattgcaattgttgtgtaccgtctggatttgcactgttacgacgtgtccgtgtcacggtgtcatcaataggttacacataacaccggttctgttgcggggcgattctgcggttgtgtgtctcttgtgcacagacaattcctcatcgctgttactcacatccttatggttgttggaaagggcgtacgaagacatggtggagatgtgttcgatcaatggtggttcaggcactactgtggagagcagaaccgtggagttataactgcacaaattttttggctttaaatttgcaccgctattgggtctgcagaactctgttggggtccaggtcaccgccctgcaaagcagctgagctgtgggtcgcgaggagataagggcatgtgtggagtgcagcctgagttgcggcgccctggtcgtctcggatccattccacttgtgcctctctaccagctccgtcgtgtgttcttcccatctaaggcgggaaaaaaatttagtttggtgtggaaaacgggcccttttcccccggggagacttctttttttttttttttttttttttgcctgccctcacaaacttacaattttattttttttggcgtgaacgaaaacgtcactttgacttgtcccaccctttgctctgtacacccgcaccttggagcacgctctatgcatgtgactcacattgggttttggtggaaaagaaaatggcatcggacccgagttgagcaggaggaggatgggtggttgagatcggacctatttgaatggcgagccaactacagatatcgagtcactttgaccgacgtcgcatcggcatacacgcccaccaatagggacatcacaatgactcactccacagctcatgtatcgtgctagcaccgatacttgttgctactagatccacacgccaattagctgcaagtacatacgatacgataccaaaaaactggtaggtgagacgatacagtacagcgacgtacactccccaggtcactccaggtcacccaggtcactccaggtcactccaggtcaccaaacacactcgggatcgttccgggtatagaacggtaattggcggatgggtctggaatcaacactggatcaagcagatgcacatgtgcccagcagtggatagacagatccagaccactgtaaagggcagaaggcgattacataatccatcaatattatgaaagtactgtaggcattggcgagttgtgacacactacaaatacttccggtttcacacgctctcagaaacaattcatctaataatctattaaccatctaataaacctccagaacatatcgtccggcatccttgagctcctcaatggctcgagccgagtcaagcttctcgcctcgttcctcagcctcagtctcaatgatctcggaaagaacctgggtcacatcaggaacaggccaggtaggaccacagaggtagaaacctccctccttcttgacaaaggcatcaaccagatcgggcatggactgtcggattcggtcctggatgtaaatcttctggggttggtctcgagagaaggcagcaccaatgtgggtgatgactccggcatccttataggcctcccagagctctccgtacagatactcctctctcttgtgtcgagatccaagatacaagtacacgtctccaatttcgtggccctgctctctctgccaggccttctcctcaacaaaggccttgaagggtgccagaccggtacccagaccagacatgatgatgggctgagtggtgagaggaggcagcttcatgacggagggcttgacagacacaaccagctcctcgccaaccttgaggtcgttgatgtacttggaagcctgtccgaatctctttcggcccttggggtccacccagtcgaccaccacaataagcagatggacggcgttggggtgcaccttctgggaagaggcaatggaatactctcgtcgcttcaggggagcaacaatctggacaagatcggcaatggtgggtcgggcagaagggaactcggcaagaatgtcaacaaaagaatcggtatcaacctcagatcgcttcttgagctcctcggcaccagcaggagaggcaatcttctccagagcagccttctcagcggcgtcagtggcaaagggagcaagagcctcgtagaatcgcttggggggttttccaaagagatcgaggtgctctcggcagatctgcagaacagttcgagtctccgatagagaagagtcctcagagtttcggatagaaacaagttcgttggggttcaggccgtaagactcaatgaactggtcaaccagctcggcattgtttcgagcgtgaacaccaagagcctctccaatctcgtacttgagaccggtgccggtaatgtcgaactcgacatggaaaatgtttcggtcgtagttctcgggagtcactcgtcgtttctcctgcacctttaccacaaagttcttggtggagatatcgggtcgcaaagagttctcggttccgtaggcctccttgaacacgactcgcttggcagcctcggaaatagaggcagcagcagctccgccctcctcgtcctcacctcgaacgttggcggggccaaaggcattgacggtgaagtaagggggcacctcgagctcggtctcaccctcaacggttccccatccctcagtgttgatttcggtgagggcagattcgtagacggtctcggcgagcttggcgacggtggaagcaaccagctcggtgtcgacaccgttagcctggacaatctttgtggtgatctgatccagagaaagctcggggtgggcgagcttccagaaggcaagctgctcaatcatgctctcggttcgcccagaggtctcggcattgtctccgacaatagaaggatcaacaatgtggacagcggcacctgacagagcgacagacagcttgaaggagtcggtcagtgccttgtcaaggtcctcctgcttgctagagccgaccagcagcagatcggtctcgggagcagtcacgttgagagatcgcacaatggacagatcgctgacaacggtgaggctcttggggatagcccggtcggtcgagatggtggtcttgaccactcctccggcagtgtagttgtcatactcggagtagtaggtgacggcagccttgtccagagccagaacgtgagcagtggcagctgcggtgttggcagtggcagcattgtccaggttgaagaaggtgtagtggggcttgggggtggtctcgattccgagaaggtctccgagagaaagaccgtcaatctccagagaccgggcatacttgacctcatggaccttgactcggccaaagtcagcagagaaggcaatggctccggacacgtcagcgaacagcagcgagtgctcgtaggcagactcgacggcgacagagttctggacctggcccaccacggtgatggactcggtggtcttgggcagagtcttgaggaactcggcctcaaggaagggggagtagattcgcacgacaatgagtccggcggacttgggcagaatctctcgggcagcctcggcctcggcggatccaaacaccacatacacctgcttggcatccgcggctccctcgtactcaaacgccttgtagctggttcctacggcagcgttgaagttgtcgagcacggcggccacggaggcgttggaagagtccaccagcgatgagtacaggtcgtacacagccttggtggccttgatgtcactgactcgggaggtctgtcgcagaaagtgcaggccgtcgtagacgtggacggtggggttggcaatcgacagcagggtagcgagaacggtcatattctgggcctcggagggcttggtggaggagaccaggccgagtccgatgcttcgggcaacctcgaacacggaggagtagtcggtcaccagctgctcggcgtcgtggtcgtagtcgacagcggcaatattgaacgccagaggggaggaagcggtgggcttagcggagtaggtggccagcacgggagccatgagcttgagggtagctgaggaggccagcacgctctgggctccggagggggcgttggatccggtctggttgtagatgtagcccagcaggatagcggcggctccgactcgggactcgagctcgacaaagtaagggaccttgcctgcgccgttggtctggtccttggcgttccaggtcttgacggctcggtcgagatcaaacgactcgggcgagtaggagaagagcgccttggatagcgcgtaggcagtctgctccaccagcgcctggcccgtcaggttggaggttccggccacggaggcaatgtctgccgacagagggaaggggaaggccggagacgaggtggtgatctgcggcgccttggtctttgcgcccttatcggactggggcgatgccgaacggttgtcctggactgaaggagccattcttgttgagctagagttggcggtttgtggggggagaaagttggctggagaggcgggcaccgactctatttattgcagcaggccctcctgacggggggagcagccttttttcatgtggctgatcgtggctagtagcataggctctgtggcgcgtcatctggcttgaaaatggcataaagtcccgtgcaaactctatgatcacagatgatgtgctaccacccgaggattgcgtgggggggaggtgttaaaatgaaacgttatgtttttgccgcaacgatatgacatgagctattttgccatgggctgaaatgactggcccaagggcaagtggatcgcaagagtgcttgatgacactcgacggtggtgggtgattagaactcgtcccaaacatcttgccggagccaacaacctgtggcttgcagaaacttgtctgtcacaaggtgtgttcaggtggctaattcgtggctcagagaaagaaaaagaggcaaaaaaaaagcttgaaaggctgaaaaataaaaaacattgattttttaaatttttcaatttttttttttttttggcatggcaagtttcactaagccacagatgacgttagttccaacaacactcattggaccgagacaagccgcagcagatggatacacgggtatgagtgcggtacgggtgcggcagtgcgatacttgtgcggactcgttacaaacaatgaccttagactggtactgtacagactggtacatgcttcatctctcactagcccgatccgagaagactctctcaattacaccttgccagaagccaaacacccctgtggcaatgtggcagtgtggcaaggtgtaattgtggcattggtgaatcggtggcattggtggcctgtgtctgtggctctccgagtcagagcatatttgcgaggcgcgagttcgatctggagctggacgttgcaagcaaacgtgtgtgaatgatgcactggcaatatgacagtttatgggcggtcggcagtgtatgggcggtcgacagcgttggcaagagtggaattcgtattcgcgcttgtgggatcggtgacggtttcccacttgtaccggtggtgcgagtgcttgatccacttgccaaatttcttgccgatcagaaggaacagaaaagtatgttaagtacgactacaggcatgtacccgtagttgcggtgactagacactaccaatgaaacagtggtgattaactgatgagccgcttcggtgtactttgaaaccgtctctgaaactccatctggtcttactctgactgaacacataatcggcctgcagtttgtatgtactgtatgtatatatttgtagctacttttactgctgtcaagcaagcaccatagagacgatgggggggttttatcatgtttgtggaattgatgactctctgtctttctttctttctgattagtggtatactcctctccccccagcactactacagtgacttctcgtcgcaaaagctgtggttgcaaaagttgtgattggtcgtctgcttcaactatctaccaactgtaatgtcaactattaacagctttttacttcaactttctacccgccaaatgccaactttaaccccacacaatgtgcgcataatcacattcacctttgaccccctcaatatttcatacccgcctcctcctccactcgataccaccaaaagccatggcgacgttcaggatctgcaaatacatctatctgcacaaaaacatgccaactgcacagggactggtcagcagcggcattgaccgcgacgcgtccgaatggaccaaatacccacactcgccccttcagctctccattgataccacccccaccgggggcgcgaaaatctccctcaaatacgaaaacacctctgtggagcatctcgacatagacgagattgacgagcggttcggatccatctacggaacaaacaacccgccgttggtggccagttgtaaacagccaggaattggcttcaagtacttggtgaagagattccataccatggtgagtgtgcaacgaggagtcgtttctgaataatattattgatcccccacgccaccaacaataccctgacatgatcccccacgccaccagcaataccctgacgcgatgtccctcttcccgctaacccagacttatcgcttccaaatcaaagtctcgtatatggacgattacgaccggacagtggaaatgcaatccaagacaggagtgtgtatcaagggtaggccttccaagtctaccacgactgaagatgccacccagacctccttcaaagatttcaacccaaagttccggtggaacggagagagtgatgatgatgacctcacccagattgatgcctttctcatgtctcaaaccctctaacccaacctcctggttcggttgctgagcctgcatttatgagccagacattggttgatacacccagttcgtcgcagtcttatcagccggtgaagccaaccccgttgtcgcggccacaccggccaaagatattctctgagacttttactttgaaacacactgctgacagtatctcttatctgggggcttctccagtctgctcgccccacccccaactttccgaaacgagccaagttgtggaagaagcactttacccctgcagatacggacattcggagcgggaatgggatggtcagcagaggaacccagaccgagaactccaaatggctgactgacacgcgagcgatggagaaccacattgtggatgtggtccaaaaccctctgttcgacgcatatgttgcccgcatcaaggagttaatgaagggcaaccaatgagaggacggattccgtgagaagggcgtgtgtgtatattagttgtaatagatgtattattgtgaggtagtgtcatcaggatctacccgtgtgctcatgtgcttgtttgtttgctcatgtgcccatgttttctcttatcaatcataatattcacgagagcttaatattgtgatgattaagggattatagctatcagagctacattttgcctgctaatactcggccacaaggcgttattagctgtgaaatgtgcgataatagctcgacttgttttgacgtgctgtgtgcaagtaccactaccactatttactggtgctttgtctcgtcatggtgtctcgtcatggtgtctcgtcatggtgtctcgtcatgatgcatcgtcatggtgtatcataatggtgtatcataatggtgtatcgtcatggtgtatcgtcatggtgtatcatgagttgacgctccgtaacgccggccatgcctcgcacttgtctgctgtactgaatctcacctacgtgatattgcacagtatcggttcgacaagtaccactccctcggcaattatatgtagccgttgccgaaccactgtcccaaggggtcccaaggagttgccaccaacatggtcccaataataggtctcagtaatacgaccccctcgcagccttgggcaatgcaacactgccctgttgagagagccacagagcgtctttagcgagcaagaaatcggcctgtagattgctcgtggccatttctcagcggcccccttgtagccaatcacgctccacgtggacgtgggatgcgatggagctgtactttggaagcacggattttcaggcacgccataaaacaccggcgatttaaacgtgcttgtcttgctacaaatgcgttactgtaggggagtgtggaatgtggcaagcccaattcagggagcttttcggctcgtacttgtatagtatcgcagagggcggtgtacgactgtggcatgacgtcatgtggcgagtcgtcttttggggggtggaatgtgtttgtgtgacttgtctggggttgtgtttggttcttgtgtttttgttatataaacgggtgtttgtccgttgttgcttgagccctctctctctttctactttgtacagtatgggttgtggtcgggtggctaaatatatctctgtgggcatatacactgagaggactctctcttgtcactctgctgagattagccttcggcttgtgtaccaccccagagtttatttttcgtgcgcgttttcggacaacccaaatccagggaaaaatcgcagtcaggtacgtacgcaaaaagttacaccgtggagcgcgatcctctgtgactggaaacagacactaagagcaggcgaaggtgcattcattcctcgacacaaaagcaagacgacccagacccttcctcaacacaacgcaacgaccggaatacatcccgactatcctccacggctccaaaacaagtgcaacaaaacaagtacaatagtgacacttgagcaactacaaataacaacaagaaaccgatgctcaaagacctgttccacagaatcaaatacagactgctccaggacgcgccggtgggctcgtcgttggcgaagctggaaacgtcgtgggacccacgaatatcgtgggaaaagctgagacgcaaacggtggacgtggagcgactggccctacgtgctcatggtgctgtcgctgaccatctgcctgtcgatcctgcagacggtgccagcattcgtgcgtgtcatcgtggcgtttgtgctcttcgcgctggtgtccatccccatcacatcgcagttcttcctgcctggaatgcccatcatcacatggctggtgctgtttgcctccccaacatcgctgccgctcagcctgcggcccaaaatctacgtgcgtctgctgcccgcgctggaaaccatcctctacggcggcaacctgtcctactctctggcccaaatgacccatccagtgctggacattctggcctggcttccttacggcgttctgcatttcgccctgcccttcatcctcgccgcatctttgtttgtgtttggtccccccggcaccctgccccagtttggcttctgcttcgggtggatgaactactttggcgtcatcatggagctcatgttccccaacgcgcccccgtggtacaagaacatctacggcctgcagcccgccaactacacgattcacggctcggccggcggactggagcgaatcgacaagattctcggcttccagctgtacggcggcacgtttggagcgtccggaatggtgtttggcgccttcccatccatgcattcgggctcggcgtgcatgctagcgctgtttgctagccatctgtgtccccggttcacgcccctctttttctcctacgtgctgtggatctggtggagcacaatgtacctgactcaccactacttcatcgatctgactggaggagcctgtttcgcatacattacctttttcctcatccggcggtcggtgctgccgcgaatccagcgagacaagatctcgcggtggtcctatgactacgtggagcgaggtatccagacccagtcgaagttccgaaagtccatggagtacgatcgggagtacattgagatggcagacgagtttggcgcccagggccccgagcaccgactggaggacgagtcggatgatgctgacgacggcattctgcccgccagcgacgcagacattgaaagcattgagagcggagtccccagtacacccattctggagactccgtcttcgcgcatggggtctcccatgatttcgcggataggctcgcctgcccccaacaagcaggcgtaaactaatgacaacagtacagtatatatataccccatttgattctcgtcattccttccagcctctctctttgtcaattttaatatccactaatataggaaacggtgcatcaataatagattatgtgtgaaaacaccagtatgagagtttgtacgacttcaagttgagtacgacttccacttccacttccacttcgagtacgacttcccctaccggcagtacttgtagataacctacctggtataacgattaatagtacattgctatgaataatttaagaagccccgccgagtgggtgctatgtttcttttggggtgtggtcatgagatactccttttacctgatgtgtgtaccagtgaccacgttgtatatggtgattgcgacgagataagcgggatctagtctttgtcttttcaatcgatccaggctgttgttaccttgcaagcggtgaccctcgagaccgttaaatacagcccggtgtcgtaccaccagttgtgtgagatctaggcaggactggtccgttgcagaacatcatcaaccgcctctgtcatttcaggatacgtttccttgacgtttttggccagggtttgttgaaatttctgtgttagaatgtgcaccacatgaaatatcaagtggaatatcatcactcgtgctctcccttactcccttactcactgtgtagatgtccatctttccatggatgaactggttttgtttcagcagcagctcgacaaactctctggtgtacacgtccgggtttcggccctggtcaatgtagtcgatcacgtcgatggggatctgtttgtcgcacttgatttccttgagtcgctgaaactccttgaccagagtgtccatctgctcaatgagcccctccttgttctcctgagagccggtggtgtcgtgtaccagcagcgagatttccacgagggtctcgatcgtctgccgcagctggttctccagttcttgtcgggccgcctctgccatgattttgttgtttgtggagtgcaagtggatgcgtcttggtgataattatgcagggtcacgtgtgaacaagaatgggttggcaagtctggagctggaatgaaagcggtgaaggcgtgagccagagatggatttgctaacgtaagcatgtagaccaatcttctcagtcacgtgttcccctcttggttctgactgtattagtaattctctctccctcagtcgcagtatcgacgaggtacgagaccacaccattctgacgattagtaatgcggcaaaatgacgacatcaagtcccattgccacatcggaggcttcctagagcccgcaacagacatgacaatcccacacagtgcggttttcttgtcacatttccgttaactcctgccattaggaacctagtcatttctcggaacaagtctacaggaatcatggcggtctgttggacatgatctgggccttttgcaacaggaacgtacagtagtggttctctatatataatactgcgagctgctctgtctgtaaagtccaacccttgcacgattgcacactaacggctactatatataggccagcacaatatactacaagtacttgtacaagtatacataaccgacttgctcatggtgacaaactttgtgccgttcgagtctgactttttcacgatctttaaaattaaaattaaaatatatatatatatacatatatatataaaaaccacgatgcggatgagtgcgtgttggagatggattttgaagggcattgaacgcgatgaaatgctctgcgaccttggtccgttgaaacgtgtctttgtgagccttgtccacgccccacgtagccccaatcgtcctctagctggactaaagcaatgcaccccgaaaagtaggtccgaaagtctttctgacaaatggttgggtgggcgagtacagtaagagagaaggaaaaaaagatgggggaaaaaaaacatgagaaaaaacatgagaaaaaaaattgtgtatatatactggcaagatggaacgccaccagagtgaagacccgacgtaaaatactcacgtagcaaagagtaacgccgcagccagcgacacacagaccagctaccgctcaaacgtcgcacagatcgctataaattactccaagcactcaggtcgctgcaattatgctttggggatacatttcgtcacagtagcacagtgctggacgataatcactacaatcaacactccccagtacacagctctgtgacgccatgtcgtcccaaaactcgcacaacatcctccatgagacgcatctgttgtcggacaccagcatccacgccatagccggcgccctggcaggcacgctctctggtatcgtggtgtgtcctctcgacgtgatcaagacccggttgcaggcagaaggagctctcgacaagcagagaggctcactcaagggcggcctcacccgtacaatggactccattgtcaagcatgacggcgtgcggggcctgtaccgaggagtgatccccatcattctgggctactcgcccacctggatgatttattttgccgtctacgaaaaatcaaaatatttattgtccaccgtgccccagttggacccctatcccttcttttcgcattgtctgtcggctctgggcgccggagccgcctccaccaccatcaccaaccccatctgggtcgtcaaaaccagactcatgtcccagggccgcaacaccccctggcactactctggcacctgggacgccttcaaaaccatgtacaaaaccgacggaatcaaagtcttctactcgggtctgggccccgctcttctgggcctctcccacgtggccattcagttccccatgtacgagaagctcaaggtgatgctcggagtcagtccagactccaacaaacccaacccctgggcagtcacggtggcctcgtcactgtccaagatgatcgcgtcggcaatcacctacccacacgagattgtgcggacccgaatgcagatccagagtaaagacggccagtatcgtggcatcattgcatcgttcaagaaactctaccaggaagagggcttccgaatcttctacacgggcttcggcaccaacctgcttagaaccgtgcccgcctctgccatcaccctgctttcgtttgagatgatttccagccgcctcaaacagatcctttagaggatccccttagactccataaaacatagaaaaggctggctcttactgtatagtatatttaatgacattgatggttctcaaatgattggatgtatcccgggattcttttaaaactcttggtacttgtacaggaatacttgccaattttctgtctgtgtgttttttgttgttttttgtttgtttttttgacatcctcgatcagttgcaagtacaagttggagatctacttagccaaagtttgttttttacttggaccattcgtgtaaagcagccaagctagtaaggggctggtaaatgagatgaatgagatgcactttataatttgggcttcatatctggtttcagagcctcaatacaacctctttcgagctcacaccacccccattcccgttgaaaacccccactattgctgctcctgtttggcacctcagccgtttaaccttgcagaacttttttgacgcaggaaagtcaccacacgctcattctgcgatacaccaccaacaagaccttccttcacacaacccacatctacacacacaaacacaatgtcagaacaacaagtcgatcagccaatggtgagtgatgaccctagcccccaatcccccacacagcccacgtttctcaaactaacgccacagacttctgccgaagaagtagctcctgctcccgtgccggcttcagccgagatggaggccatgcaggcccgtctccaacagctccaggaggaggcatccaagctcgagtccatgcagcaggacgccaccaagtcgtccgaggatctcaaggaggaccaggaggagattgacgcgcgatccatctacgtgggcaatgtcgactacggagccaccccccaggagctggaaaagcactttgagaagtgcggatccgtccagcgagtcaccattctcatggacaagttcaccggcaaccccaagggctacgcgtacatcgagtttgctgagcccaaggatgtggcccaggcagtcaccctcaacgactccgagttccgacagcgacagctcaaggtcagcgccaagcgaaccaatatccccggtttcaagggcggccgaggccgaggacggggtcgaggaggtcgtggaggcttccgtggacgtggaggcttccgaggaggacgaggacgaggcggttacgccccttactagaggtaccactcccgtcacaacccacacccaccaactacaccacttgctacgaccgaagtgcttggttcaaaagactttgtatattattataaatatggattttatggagaaaagagggcatcaacaagaaaacaagacatgaaacactatcaaaagaacattgagtgtggaagaaaaaaaaaaaaatagtacaagtacaagtacgcccaccaaaagagaagctccataagcacacttgacccttcatacagactctgctgaaaaaataaaccagcagaccaggttcgatctggcatggcataatgttcaatctctcacgccgtagtcttatactacccattaaacgtatctacaggctcttcagttattgtcaagttgaattatggaaattggaagtaaggaccagtccagctggtgggaagaggaagagaaccgggctcattaccagttgggctcaccgtagccggggagccagaaccatcgccaggcctcggggttggcctcacgcttctccttgtccatatcagcgggcatggcgtctcgcttccagttgggctcgccgtaaccggggagccagaaccatcgccaggcctcggggttggcctcacgcttctccttgtccatatcagcgggcatggcgtctcgcttccagttgggctcgccgtagccggggagccagaaccatcgccaggcctcggggttggcctcacgcttctccttgtccatatcagcgggcatggcgtctcgcttccagttgggctcgccgtatccagggagccagaaccatcgccaggcctcaggagaagcctctcgcttagcgttgccagcagcaacctcggaatcaggctgggggtccatgaagcctgcctcctgggccttcttggcgtcaatgatagcaattccctgctttccagactcgtcatcattgaagaagacaaagatttcgttctctgtaccctggagaccgccgacaatggcctcctcaggaatggactgagggccatgggagccggtaccaacgggggcagcaggggcagctgaaaccaggcaggcaactgcggcaagagcaatagtagagaacttcattgttggtgttgtagtggtagtggtggtagtggtggtagtggtggtagtggtggtagtggtggttgtgtctgatgataagaaaggagagacatggaggaggtatatatacttggttaatcgttgtatatttcatcttggaaagatcaggagactgtggtgagaggtcgtatggattctgcaaagggtaattgtcgctatattcgtttgtcggtgtggcaacgaagacttgcataggataccgattaatgaaattgtcgtgcatcatcagtaaactggacaacagctctattcggtcgaaaagtggcgctagaaggccgaggaaaaagttgataggacaccatcgagccagtgtctcgtatatcttcgtttgacccagatagctccccaataggccgttctgtgcgactttttgcaaagttggccaatcttttagactcgtcgatactgtcccaaataggtaattttgcatagaaaacttctgtgaatttcatgttgggcagaaatgctgtaattgtagcggggtatctctgcgtaatgatataacattgatttcagaggtatctgtgttctttttctcgattctgtgtcgtttttcggggcgtttctggctgctgttttagggccctgtggtgtgtaggagaaagggttttgtttgggcggaagactcagtataatagacaaaatagtgacacagggagctggtttcaactaataaaacacagacagcaggtggtattaaacaaacaatacatgacaaacgccgtaccaaggcagccgtccctgcaagaaagctatttggcgacggcctcatcgatgtgaaacgagcccggattgcgaaacgggcttggttcgtgtaataggcagctatcaaacctcagcctgccagcccttgacccaaggccattgtccaaatgttcagccggttccacagcccctatctcggcagtatggcagatgaactgtcaatcagatcagtattctgactgatatattatgtacttgtgccgtgattacattaccttgtccggaatgtgaacaacaaggccccactctaccagccattcaatggacagtatcgcaaataattattctgatctccgtatctgtgtctcttcaatctacggttcggtcagatctcaacagaacatgagaggcccttgttcttaatctgtgtagcagaacagacgcgcgatttttggtatgatagagcattcggagtgtgcagtccatagatctattcatctcgaatgttcctctcattgccagtagtagacttctttatccgactgcaagaatcaatctcgcaactgcggggttcgacaataacgaccatgtagcaatccgctgatattccattgtgcacgtatcgagagactcagtattctttcctctgtaccctagccccctcttcaagttgcccgttctccatatgcatacctccgtttccttgcagtacttgtgaggccgtctactgtacagtcaagcacccattttcacccattgggcctcgtgtccagaaaatggtaaacgccggtcgatcgcctgtgtacttgcacgagtattgccacatgtctccaggtcccagcaggttagcagtcttggtggatccgacgggctgcacggaatcagagaagaatgacggcggcttgagccacagactgttggaggtgatattctcgacctttatctgcatggccggttgtctgttggcggtcttgatggtctccagctgcaactggacgcaattgacggcgttgaactggtacatttttgaaaaggactcctggtggggttctccgtcgaccacgtacgagtaggtcacgtggcaggtgactgtgtgcattcctgccgtagggatctcatacttgatggggaactgtgtcgtctggtggatttcgttgagctccacggtgtctgtcgagttgagcacttgaacgggaggttcggtggagtccttggcgtggatcgccgcagacacgcccaccttgacgctgggagccgtgttgtagatgaagtccgtcttgagactcacgtagaccatgaaggtgagcacttctcccacgtagaccgttccaaaggctggacggatgctgagccatggtgagggcaggttcaaaacggccgattgagattgcgagagcacgaatgggtcttggatggccggcgtcagctgcggtttcgacgcccgcatgattttcaggctgattccatggttcattgttgactgatgtgtgatgtgtaaatgcgtgagttacctacagtacatatctactgtacttgtaggtggtagtgattatgcaacgttagttggtgtcagaaaagacccacgaacacggtgggggctggatcaactcggatttccgtcccaaatgaataatcgctctgattctgtgacactctgtttctgtgactccgttttaagacatgttattgcaatacaacctcgggtgtggaatgtgtgtcaagatgggatcgtcaatctggattgggaaaatgaagtgataatagcgtacctttactccatgaatagcaatgaagagggacgaacaagatcatcaccaacgcacccaaacccccggacaagaatggatatatgtatatctatcgtcacgtgactggtcatagatgcatcagacacgacttgacatgacctgacacgaatatacattgtgtaaaaggagataaaaagggttcttctgtaagcacagtcgtacgtccgtttcagagcctaagatgattagggtgaaataaacgtctgatatgtgaagctaagttgtacgatagctgtattgatgatactctttttatagggcctggtagaggtaattaaacgattatactggtgggttgagttgatccagggcgacaaacgtatctgtcttatcgccactaatctctgttccctaatggtgctccgtctgcccgtctgcccgtctgcccgtctgcctgtctgcccgtcagcatccacgctttgctgtgtttatttttctaggttttcccccaatttcgtggaatttccgcatccaatttgctgcgaaatcgccgcactttgggtctacagagagccattgaacgatacacttgcacaattgcacaattgcactcgtctatgtatctcatttaaccatcttatcgtaacatagctcatcatccctcgatgcatgcatcgatgacgcgacggcaatccatgggacttagatcatgtgggatatagcagaagtgggaaaaaaaaaaaaaatcaaaaatcaagaatcaaccatcagccatcaaccatcagccatcaaccatcaaccatcaaccatcaaccatcaaccatcaagaatcaagccacatggtggtgcgggtcgcgtcagcgtcggtcgccggggtccaggacaaccgtattggccccgtgggcgtcaaaccgtcggcctaattagctccattctgtggccattggttttggcgagacatttttgataatttgataatttgggcgaattggtccacattatggcgccagggcaggggttgtgacgacggcccaaagcaaaagtgagggcggagcatatttggcataaaactggaaatgttgcatttgccgcaactgtggaggacaatgcagctcgtactggggcaaaagcgagtcttgggcgaaaatacggaccgccgcaagtcgtcgaaacagccgccggcaccatcgtcgcacgaaggaggaaccacacacacaatccacaccccctccgcccaagttagaccgccagctatatacccaccaaaaaccaaaaagagacctgggagattggcgcagacaaagaaaaggcaaattgctggagccgaaccataattagcatctggtgtcccagcccataccccaaaccccaaaccacccaccacccctcagggacacaatttacaccagaagccaaatcagcttgcagcacacgcatatacaccatttgcaaacggcttcaggatccggccgaaattgttgcgcgacacgataaaaccgccccgtgacgcgtgctctcccagatactacatcctccccactgttgctccacgtgccaagcaagcttttgcggcctttgatcaacgaatcaacgagtgatcggaacccacaaggcctcctacaagagacacacacaaacaagcgacggtcgccgacgatagtgaatcgcccgctcgaatcgcacaaaggagaccgccaccgacgaccccgacccggctcccccacggtttcttggagatctaacgtccatttcagcccgcaattcaggcctcagatccgataagagcctcagatcaagaatccaacatttccacctccaacaacaaaaccgccatggaagtcgcccgacaaagcctcgaaccattcgcgttcgctgccaacaaacggccactggacatggtcgactctgacgagccccgatcagacagatccgagaaagcaaacctccgtcgactcgccattgtcaacgaacgccgacagtacgaagagacgctcaaaccagactcgtcggacacagaacctgccgctgccacagccgctgagcagcccgccgccaactcgcctcccgccgtcgaaatcgacccgtcgtcaggcctacacgtgcccaccctacgagccacctcggtgatcccgtccttatcgctcatgtacgccgacacggctcctcgagacgtgtggagaccgcagatcgaggcctggatgaagaagtccggccaccgaatgcgcgacgtggaacgggccgtcgaggcgtccgacaagctcgacgacaagtatatgctcaaggaccccaagcccgtggccaaatccaaggcaggccctgtcgcaaagacatccactgtcgtggatgaacaactacccccacaaacggcatccatcaccatgccctcgccacagatccacagcagcgcacacgttgtcagcaccccacagatcacagagccacccacgctcaaacccccacagtcccccatacaacacatccccccacccccacacatggcgtctccacacccgtcacctcatatggagacctcaatggtcgcctctccggcactgtcgtcgcctcccaaacccatccacagtgcctccacatactccacccccagctatggcaagcgacgatgtatcagttgtggatcggaccagagtccctgctggcgcccgtcgtggtctgcatcagcaggacagctgtgcaactcatgcggtttgcggtacaagaagactggagcccgatgcaccgagtccgactgtggccggatcccagccaagggcgagtgggcagttatgcgaaacacggctaagcgaaatccggaaaccggccggatggactatgcatgcatttattgtcgaggagtggtggaagtgaatgagaggttttgaactggacaaggcatgctggccagctaacaacggcgagagattggaaacgaaggacgagacgagacgagacagcggacacaagacagttcttgctaatcaccactgtctgtgttatgacccgtcgacaagctcgtcaaccaacagactgacctcccacctccctccaccgtgcaacgctaacactaacgcgtggctattttgtatggaatagccattgatgacttatgatgggtattttttggaattgtttttttttggtttttgatgttatttttgtcttgattgttttgtaagtatagagtgataaatgatgtttaacagaggtatcttgggtcgtaatagtagtatctcggacctatcttggtggttggtggttctcatacatgtatgatgcaaggaagacgtacggagctgtagcgaagtccattgggtcacgtgactgcgagtcgtgagaggtatcgccttgatggtagcagtggggtatgattctgttgagttgagttgcttcttactcgatcgctacaagtacagtagttgtcggtacttgtttgtctcttggtatggtgagtgtcgatgttccagaacaatctgttggaaaaagagtcgtttagcggagtttcgaagtgtaaggtttgtggttcgaaaccgggatgggtcgcacaagtttgtgtcagaaacatgtctgttgtttgtgttgttttccgacatttcgtcgccgtatgttggacttccgcggagaggatgggtgtcttgggctgtggagaggatgtcaagctggtttggtgtgtgtttctccaaggacagaggcgctattgagaaacagagacttgtgttgtgttctcctcgttccggggatgtcacacgtcagcttttcggccggtttctgtctctcgtcgtgtcacagatggtgttgttgttgatgagttcctggttgccctgtttcgcacaaggtggtgcgtgaggttgtgtggagaggggcttgaaggaggggggtcgaggtgcaggagcgtcccccgaggggccctaggccgtcacatgaccggcataatggtgtggagtcgggttttggttttcctggcgggttccacacttgtcaagtctcgtttttcaggctttttttcactcgctctttttgcactttggcatctttttacctttggtgcttaccacctttgtatgcaggaaatctattgggtttggtgtataggtgaaaaaaaaaaagccaaaggtgactgtttttttccgactcggtcatgttgcattttgtgcgatattataagtggggaacgaatggaggcgagctggtgtgatacgggagctgctgtttctcacgattctgcccagccatttatcacgcgcacgctgacatcttgcacttagtcatcaagagctacagtacgacgagtacatactagagccaaccactcctgaagtgcttccatgagttcagttgagtgctgaaccaactctcgacactctcgacagcctgtgaaaaggaatgagtgtgtggaaagggattcaatactggagaagagaggggagagatcgagagggtgatgttacatccccaagcgtcgtagtctcgcgttgatgactggaacggactgttgaacgacgatcaacatggtgtgcaagctgatggacagttgggccaatggttcagaagcgttagttgagcttctaacgacctactactcgcctgtcaagtgaggtgtgtacttgttcatactcctactcgtctcactggcgtctagggttgtgagcaccgtcgcttatgaaagacgccgtcgcctatgaaagacaccgtcgctcattgaagactagatccataatataaacaaaagagtatttctctgaatggcgacggattggccagccccatcgttacacaatttgtccaaaaacaccatctctgccgtccatcgatatctttcgaaatcatccggaccagacagtagagctttgagaaccccgaaggaggaatactgcagtgaagtgttctttgaaactctgactggagtatctccatttctatatctccattagtaatcactccaaacagatgtcttccagcttgagtcagccgagaccacggtcacgtatggtgattccttcaaacatataactccattgacctaacaagacactggcagttgtaaatacgtaaatacattcttgatgtaagttttaatctgattggagactcttctgagtaacacactctcttccaagcagtcattttggcctttttttcttccaaacccgtctcgattactcatcaggttttatctgagaaccaaaacgtctcaatcattgacatattgtaccatcaactctgtaaaaacttgacagatgtgctacttgtgtcattatgaatcgattttccaaatatccattatcattatcccatttcttccccgatatcacctccccatctaccacctccatttaccaaccaccatgctcagtaatcagaaactcctcttcacagaccacaattgccaataattgaccaccaaaagtcgtaccatgtgtttctccggtgaccaggtctcgctttcacccatttattccctcaaaaacacccctacagtaatttcagcgcctttccatcaaactccatacttgcaacaaaatcacaatggccccctgcctaaactacgcccgcccataattgagtatatttgtatgacaatcccgctcgaaatttggcccacttgttccccgagctccaaatattcactattcaccttcacctcgtgcccaccctggccccccaatgccccccgtgctcgtaacgtctccctcccccacaccccacacacgtgacataaagtgtaaagtgcgagtacctcggttgtgcatgcaccactccaacatgacatcgccaaccagatcaccacccactacaccttccaggaaccccacaatgacggacaagctggtcaaggtgatgcagaagaagaaatcggcgccgcagacgtggctcgacagctatgacaagtttctcgtgcgcaacgccgcgtcgatcggttcaatcgagtccactcttcgaacggtttcgtacgttttgcctggtcgattcaacgatgtcgaaatcgccaccgaaacgctctacgcggtgctcaacgtgctgggcctctaccacgacaccattattgcccgtgcagtggccgcatcgcccaacgctgccgccgtgtaccgcccgtcgccccacaacagatacacagactggttcatcaagaaccgaaagggatacaagtacgccagcagagcggtgacctttgttaaatttggcgagcttgtggcggaaatggtggccaagaaaaacggcggcgaaatggcccggtggaagtgcattatcggtattgaaggaatcaaggcggggctcagaatctatatgttgggctctacactgtaccaaccgctgtgcacaaccccctaccccgatagagaagtcacgggagagctgttggagaccatctgtagagacgagggagagttggacattgaaaagggactcatggacccccagtggaagatgcccagaaccggacgaaccattccggaaatcgcacccacaaatgtcgagggctatcttctcaccaaggtgctgagatcggaagatgttgatcggccgtacaacctgctgtctcgcctggacaactggggagtggtggccgagttgctgtccattctgcgacccctcatctacgcatgcttgcttttccgacagcacgtcaacaagaccgtgcctgcgtccacaaagtccaagttccccttcctcaactccccttgggccccctggatcatcggtcttgtgattgaagcattgtcgcgaaagatgatgggatcctggttgctgcgacagcgacagagcggcaagacccccacagctctcgaccagatggaagtcaagggccgaacgaacctgctgggatggtggttgttccgaggcgagttctaccaggcctacacccgtcctctgctgtattcgattgtggctcgactggagaagattccaggcctgggtctgtttggagctcttatttccgattacctgtatttgttcgatcggtactacttcaccgcctctactctctaagcgattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtctggctcattctgtttcaacgcctttcgcgccagaccatcaaccttgttgagctctccgtcagcagcctcgaccagatcatcaaaaccagaacccttggctcgagttcgggcttctcgaagcttgtctttagcctcttcataatcgcccttcttgatagcaatcacaccgactccatatgtgcatagagcctgggcctcctcgacttccttggtccgtcggacatcgggctcaagagaaggaatggccttgagaacacgcttgtaacatgactcggatcgagccagggcgttattactgctcgtcttcattgtgtccagaggaatctcgccgcctgtgtcagctttgatggtggtgccctcgttcttttcggcagtgtgaacaatcacctccagctgttcagacatgaggtagaacatggaggctaggttggcttgggctaacaacagatctcccactccacatccggaagcaagcatgatctgataagtgatttgcttctctctgagagcaacgttggcgagggcgtcagagaggttgtgagttgtgagcacatcacgagcagcaataagctcgtctctgaagggcatccaggcgtcgtaattgccggaagcacgcagcagacgagcatgagacgcacttttagtcagctgggtcatgaactcccgctcgctctgtgtcgggggcgtgctggcgagtttcagcagatctgtggcctcggggcaccgtcgacagacctcttcttgagccagcaggatctgcagcagtagcgctcgtgataccacatcatttttctcggttccagaaatgtgagcgagcttgagagcgatccgcagacctctctggatcacctggggccggacatcctgggcgattttgttattctggaaggcgtcaacgtaggcagcacaaatctccatgtacacgtcgtgggcagcgtccgggtagttgagcatctcgtagatctctgccagtttgagctggatgcctgtgtattcgtccgacaagggagacaggccttgggcctcggcctccataagtgcctcaatgtaatacttgacggcctccgggaggttttggccgccaaagctttcgctctcggccttgagcgcctttcgcagaatggtggcgacttccggggtgaaggtgtgtcgagggtagaagtaccatgttgtgaagccggagatggctgccaggaggagcaagatagttctaaaccggaccttggagacgggctcggccacgaggattcgtcctgcagctccggagggaggagggggggtttcgccgttctggaagtacgatttggggccacttgaggacgacccactgggctcggggggaatgtcgcccttctggaaattggtcttgggaggcacggcgtagtttcggaccatgattggcggcatggcccggcggatcggaatagccctcagctgagcgactcgcgataatcggagcattgtgtgttttggcgatggcgttgtagcacgatacttgtgtatacaagtattttcgagaaccgatattgggtggaatctaacagactctgatcgtgcatctcctatgcaaacggaagagttgctggtggcgggcgtagcggggcaatggggggcaataacgggagtatttagcggttgtgcgggcagtacggtattttaggggagctcagatggtttatattgggttttgtctggtcaaaatcacgtctttatgcaagtacttgtagagtattgtagttggagggaagatacttgtataatcaactaatttaggtagtgcaatttgtgagcattttggcaagcagttggaaccttgatgagtcatctgaattgatcatttggttacaagtatgtacgtgtagttgtaggtgtacttatactgacgcacttgtacctgtacactgactatctacgagtgaccccttctactcctccgttccatgtatgccaatatttcagctgaagctacagtatttacatacatactgtataacctctcacttcgaagtcagtagacctactgtgacagatgaacagattgacgtgaagattttcgtgtgaagatttttgtgtgtagattatatatattccgaggaaaagacctgaatcaaacaaccggcccaacaaggacagctgttatttccccttttttgtatatatcagcctacgctgagttgcatcatctgtagcaggcgcttaagctgcctcagcgcgatattgtgagacagactgcgagcatgatgagtacagtagtggagataccgtggaacgggtggttagagggaaacagagacacaaaagtagtccgtattgatttgctcgagcttctattatcgtgatattcacacatctcctatcgataaccaacacgaaacttgaccaccaccgcaaagctcaaaaaatccaacaaaaaatccaactaaaagttcaccaaaacttgccaaatccaactaaccttaatgcaaataaaggcggtagaaatgggagtttttccattctggtccaattgatgagtgaaaagaaattcaaattaaagtacaaatttcgaaagaatgatgcaaattcgactctcaaagattgtgagataatgaatattgcctcggatatactgcactcgctcgtaggactagggttgatcgactcgagtcttctcaatctaatgatttcacagggttaggacaagtccactgtgcccagacctattccaataaacacccacaatcaactaatcattaaaccaacaagttacaagtagcagactcggagatatgtacatgaactaattataaaacacatcctaaatcgaacataatacaatacgcctcgaagatgaatcaatcgacttttaccaattaatccaattaatcgaatttttcgaattaatccgcacgcccttctctgcccatgacatagtttttccggatcttcggtatgcttccttttgttctatttctgcccgtctttttttccggctgagccgctcctccctcccgctggaccgcgagatgcacacgatggtgctgaagtggcgagtctgctacttgtacttgtagtacaccttactgcaagtgatttataagcagaaagtcggaatcgcggctgtaccaccaccgcacagattacataagctacattcccccccaaagccccgactgtctcagcaatattgaatgagtcaacacttcccctctcaccaatatcttttcccctcaaccgcacgctaccaggtggatcttgtcccttgtcttccatagcaacaatttgagtttgtcatttttcactcaaagagggaggagacagagaggcgtgtcttgaggacacaatcgtctccaacagccacaattccaacggcagcgggaaaccaaccagatggccgtactcgccgcaccgccagctccacgccagtcctgctccacagccaaaaagcccccgtggcaaccaaatatgtcacccagtgcatgtggccgccatttccaagccgcacaaacggaccgcattcgccgtgaacagttgccttttggggacggggcaacaaagggaattagtcacggaggtggtggcggcaaaaaaacctggcaaaaatcgcaaaacgcaaaatggcgtgccaaagggtatatatccgtgtcacagtcggagtgcaaaagttttcctcatcctcaatcgcctcttgtcgtcgactttttgaactcgccagcaacaagaacccgtcggaaacgccgttgattaagtattttctgagaaagacaagcttatcgccctgacaccagcttctcgactttttaagaattcactgagtcaagtccatcaccaccagacaatcgaaaatcgtcactgagtccacccaccgagcactgagtaacgagtcacaaagagagcgtccccaactctattttgcattccttttttggccaaccctaatcaacaaaaagcttaagttggaattcccacatttggaaaaaccctaaacattaagcaacatcctttttcggacaaccccaaccctaatcaaccccccaagcctaactccgcaacccccaccatgagtctatctgccttgcgtcgaatcggacaacttagacatcacttcaccagtgcagtgccaattgtgtcttccacttctcccactacacaaccgttcaacaccaacaccctcgcaaaacacatccacaccaccccgtacgctctcaaaaacaaaatgaccgacattaccatgatccccggccccattgagttcgaccccgaggtcctctcagccatgtcgcaccagtcggtggcccacaactctccccagtttgtggaggtgtttggctccgtgctcaccgatctgcgggctctgttcaagtccaccgaccccaaggcccagccctttgtcattgctggcggaggaaccctcggctgggagattgttggagccaaccttctcaagcgagatgacaaggctctggtcatttctaccggattcttttccgacgcattcgccgactgcctcaaggtcttctgcgaccacgtcgacgtcatctctgcccccgctggcgaggccccctctctcggtgagatcgagaccgccctcaagaaggagaagtacaacctcatcaccctgacccacgtcgacacctcttccggagtcgtgatcgacatcaaggccatctccgagctcgtccacaaggtctctcctgacacgctcgttgtcgtggacggtgtctgctccgtcggagttgagcccatctcctttgacgactggggattggactttgtgctcaccgccccccagaaggccattggtgcccctgccggcctctccatctccatggcctccccccgagccgttgccaaggttgagtctctcgagaagatccccgtctactttggcaacctcaagaaatggctgcctatcatgcaggcctacgaggcccgaaagcccgcctacttctccacccccgccgtgcagaacgtgtacgccctgcaggttgccctcaagcagattcttcacaacggtatctcgctggaccagcgtttcgagaaccacaagcaggtctccgacaagatcaagaagcagatcaacgactggggtctcgagattatcgccaagcccggtctcggcgctcacggcctcacttgcatctacctccccgagggcgtgactctccccgactttctccccaaggttgccgctaagggcgtgactctggccggcggtctgttcaagggcatcaacacaaagtacttccgattcggccacatgggtgtttctgccgtcgaccccaagcgggatgatgttgaccgaactcttaaggccatccacgactctcttgtcgaggctggttacaagtgctaaaactatcgaacgtgacgagatagtttgaatgcgagacattggagagcggccgccaactctctccaatgggaacgacgtatagtatatatagattgaagacgatgtttgtaatatttactgattgtgtacggtaagtaccggtgcaaccatgccgattgtagtagtgtaagtagtgtaaacgatgatatggagcagggtggagaggggtggacaagaggtactgaacgagtgcgagtacgagtccgtttctaaagccgtttttctaaagttggtaacttcagagacttacagatgctggttacttgtacgactgctcataagcccaagtataggatcagatcaggggtacaagaacttgtagatgcctctctgacgccaatattctctgtagcaacgcaccagctcggacttttctgtgtgttttcccagttgtaacgctcaattgggttgaaatgaccagataacaggccgatggaacgtctcgcgaggtgccataactcctcaaagccccacggtctccacttgtcatgcccacaaccactcccaaacgcgtcctcaggctggaacctaaacacgaaaacactatacctatacgccacacgtctaaccacagactgatttccccgaccaccaatgttggaacccggccacgatctctacgctattattgggcttgtccagaccgacaaaccgaccgttgcgatcatcaaaacgtcgtaccgacgagcggctctcaaagctcatcctgacaagggcggatcggacgttgagttccagaaggtggcgtttgcgtacgccgtcttgtccgacgagcaccgtcgaaagcgctacgataccaccggggagtacacagaaggtgtggatggcgatcttcaggactatttcgaccaggtgtgcaaacggggtgtgaccgaggagatgatcaaggaggacaagaaggcataccagggcagtgaggaggagagagacgatgttttggaggcctacgaggagtacgaaggagatatggatcttcttttcgagtccatcatccactctgagattgaggctgatgagaagcggttcaagaagatgattgatgaagcaattgagtctggagacgtgaaaaagtacaaaaagtacgccggcgagagtaacaagaagacgcagaagcgactcaagaaggccaagaaggaagaaaaagaggccgagaaggcagccaaggagattggactcaagaaggaggacggcgaggctggtctccaggctctgattctcaaacgacagagagagcgacagggaaactcgtttctggacaagctggaggaaaagtacgcccctaagaccaagaagggtaagaaaagagaggagcccagtgaagaggcctttgccaagaaccgcaagtccaagaagtgaggagttggagagagctttgagaggctgctggacgagaaatactggacaagccaccaattgcgagggggttaagtggggggtgatctgtgagtaataaccatgtgctacaaccctcttacagagcctcttgaactgttgtttatggtgtctgcactccaacttttggactaccagtacattcttcggtagcagggaacccctgtgacttacaccctgtctctaatcatttcatgtataatatatatgtattcttgagggaataagtaaccagaaataggccaatatttgtcgataatgaggtaatcatccgtactttttgcaacactcccgctcgtactgtagcatgatcaactttaatgatgaaaatatagataaaaaattggatcccgaaatttcaatcttaccgcgacaccggaaagcagaacgcgaaaaacaacatggtctactactacgaaagccaggtcgtcgacccgtacactactctgtacatgggcaaagacaagtttgagagtgagtgtcgcgggggtagtatttgtgcaaacagctgagatgaaagcttgtagtggagctggagggcggagagacgacggtctagatactccgaagacaagagacctatggatacattgtgtgccgagagacgagggttgatcagacgttcaagtttgcctggacagaaagaagactgtcatattgaacatattgttgacttgttgttgacacctactggggtctaactgctaccatttcctttgccctcaggtccttgaatggttggacgtttggacattcaccgttgcgtttataaggaggccactctgacccatgaccactaacccagatgaaaacctgatcaaaaacggctggctcgaagacgtgtggttccacgtcgacaacctctcttctgcccacgtttacctgcgaattcccgagggagctgactggacgtttgagactcttcctgcccaggttgtgcaggactgtgctcagctcaccaaggccaactccatcgagggcaacaaaaaggacaatgtgaccgtcatctacactccccattccaacctcaagaagaccaaaggcatggccaccggtcaggttgggttccacaaggacaccctggtgcgaaaagtgcatctgaaaacccgtgagaacggcatcatcaaccgtctcaacaagacgaaacgagaggaataccccgatctagaaaagcaaaagaccattcacgaaagcaagaccctcaaagaggccaaggaggcccgaatggagcgagaacgggccgagaaggctctggaggaagagcgagctgctgaacgttacagaaagaagcatgcctatgatgatttcttcagcgaggagaatatgcagtccagtgagaccacggggaatattgaggatgatttctggtaaggacatggccaaggacatgagcgactcatttcaggaatgttcttgagcggctgatatcaggaatgttcttgggcgactggcttcagtaatgcacttgagtggatgagttccgttaagagcaactatttcgacactaccagagagtgactgtaccatatatcaatacattaatttattgccctgttgtctgtagcgcttgtgagtgctctccacactcgagtatgtactggtacagttggctgagatgaaagcaggactgaaaaaccaaccaaagaactacagttggcaaaaccgataccaatcgaatcgcctcgttcgggcgagtctgacagtggtcatattgtcctcttggctatggaacagcccaccaatatggacagccttgtagaagtgtcaaaatcggtgagaatatcacgttagccagaagagggggttaacaagttcaatgcgatgatacatgatggcgatcaacagctctacaagtagtcgtgccggtacatagaccactctgtcgtaaactggtggccaagtacgtcatacgctctctacgtgttgtgctacgtgttgtggaggtccaatgagcggccatggcgcaatactccactcctccacaactcgagctcagttacacactggtggtctcactcatgtgtactcaaacagacactgtcaatgcataaattacatgccgcttaagggttaagatcaccggcaaagttgcccttctctcgctggccgtcccacttctcaatccagtcctgggggcacagagagttgtatgatcgccagaagaccttgcaaggctcaaactcctcacccttggcgttgatgcacttgaagtagtcgacgtagttttgccagcagtgcttggtctggttctggttggggaatcgggggtcgaatccgactgcgttagtatgtgcgattgaatggttgatggattgacccgctcatcttgcctggctcgtgtcgctcacgtcggctttgtgtcggttgtgtcgcttgcgtcggttgtccaaatgtcggttgtccattggtcgcttgtgtctgattcaatttgctcaatgtcgccaaacatcaacgttgggccatctggacgcgcccattgatccatgccatctcagtactcaccagtcttaaagacaaccttctgctcttcggtatcagacattgttttgtgtgtagttgtagatgatggaagcacctaagcaatatgtatccgaaagtcagctcactggcaaatgttgcaacaaaaactctagctcttaggaagcctctgattggtcctggccgattgggaggtcgagggttagggcacccaaaccctattttcgtaggcgcgagacgatactcatagagggggacggctatatatgtgtatatatgtatatgtgtgtgtgtgtacggcttgttctaggtcatgtgacttatcggagagccgattacgatacgaattgattagtcatgcctactacatcacccatgtaacccccccctgatgtttatatatatatccccccttacaccgcttgctcgatactagctaccgaatcaaaagtggcatgttcaccagccgcagccaatttgactttagctctgggcgtgctatgggtgggtggtgtgaagctggtcagattccagctgatggtagatgagtgtggtatgagggtgattgaagagggcgaattcgaaacaacgggaggcttagggaattgagcgtgtgacgtgaatgggcggagagttgaccaaaacaagttcacacctagccagtttagtgtggctgatgtggctagtgcttgcatgtgtcaactaagtacgctaacaaaaagatacaattacttgaccttgacccccattacgagttcaagtaagtgaaacaggacacggggttcgatttgagctgacgtcgaatttcacgaaagtgttctcaacgatccactaggtcgcgttttcacgtgatattcgtgtcccatttcccgcaggccaggttttgtgttcgtgacagctcttccagagctcacaacggtcgtctgttgagtcctccaaggtgaaccacatgtcagcggtacgacacgcacgcacgtaagtgcggaacacgacgacatggtaggcttacataagccaattcggcgggctccagatgtttagctacaagggttcagtagagggaaaacacgtcaattgatctaaacacgtgtctttgctccctcttgtgtttctgtagcttccccatcccgcacagtccaggaagtccaggaaacaaagtttgcgataacccagtcaccactccacagagtatctggaacgctacagacaacacatttcgcccgcccgctagcacacaaccagggcctttcatcacgatgaatacatctgcagaaggagcagagcagggcaggcaagatccccactggacgtcgaggacgaggatctttggcatggaggacgggtccgagttctggagtgggtcaaccctcacgcccaccaaacatattgacaaggtggtctttggaagcaacgcggtctggcgcgcgtacgcaaagagccatggaaaggttctcttggttgatctgagctccggacgccaggatggccgggagttccaacattgtgtgagctttgttgcaaaggacgaagacggcgacaatgcctacctcgcgtttggatacatgcgaaacaagacgattgaggacttcatgtggctgtttgatatgatcaaggtccagttcaaacaccactcggtgcctcttcccaagaccatctactccagcgagatgaaggagtgctacgagaccatcgaccgagcattccccaacagtaacatgcggttgtggcttcgagagatcaatcgggactttgtagcgcagtgccagcatctggtggtgcgtgactctgatcgagtgcttcacgacaaggtggatccttccagtttgaccaaggacgaaaacatatggcttgaaatgatgtccgactggtcggagattctggaatcagacagcaagaaccatttcaaggaacaatgggacgagttccgcgccacttacaagaagagccaccccgaagttgtttcgtatctcagaaaccaatggatcaagccgcacaagcgcatcttgacgggcttgtggacaaacaatgaagagggacatgtgtttgatcagaatgcatacatggagggtgctgcaaagtttttggagagagccgcgggctgtcatggcctggaagaccgtctggtagctattcagactgcctacagagaaaatcatcttactgagggcagctctggaaagcgaccaagcgatgaggatgagtatcaggaggatgttgatgatgcaacaagtagaattatgagcattcttcgtggaggagagaacgaggagaagtccggaatctctgaggactctgaggaagtggaagtagtggaggatggtgaggaagtggacgagggtgagaagcaggaggtttctgaaaaggatacatcggtagaggaggaggattctgaagtgaaagaggaggaagagcatgaggaggcagaaatggaggtatctgaggtgggttctgaagaggaggactctgaagaagactctgcagatgcctacgaagaggagaggactgacgagtcgggcgagagtgatgttgaagacacaaagaaatctgcaactcgggctgtgaaaactgtgaaccacccgactactcctcgaaaagctactgtacaagcaggcgctccaaccttgataggtcacctccccctcgcactggtttctcctacagccacgactttgatgcctcccaggatgacaccacttggagaggtattccttcacgttccgggaattggctatttgcctgaatggcgtgctctagagttacagaaagaatttgaagaagctaagagaaagcaggatgcggagagagaggaagatgtggtgatgttggatgtccatgacttggaaaaggaaaaagaggaggaagaggaggatgaggaggaagaggaggaagaggaggaagaggaagaggaagaaaactctggctttgatcctgattctggtaaacccttgtcagagagtgaaagggagcgaataaaggcggtcagaagaaatttgcgtctggaaggatccggtacggaacttgaaaggttgctaaattctaacaagcgttcaagaagtgggagatcacgtccatctctggatggaaccaggaagagcattactgagatccctaatgaagggaaaggcggtgttgcatccgatacttttgttgcagatgtcgacgggtcgtcagccagcaaacgatcgagaagaggtcagcagcgagcgtcttctacggttgctacgctaaagacgcccaaacccaagaacaagactcaagaaaagagtgctgagtcggagcagcctgtaaagcggggaccaggaaggccacgaaaacaccctctcggtaaggagcctaaggcggctgtaataaagcggggaccacgagggccgtataaaaaacgtgtcctgtccgcagctacggtttatgattctgattccggggatgctgccgagccgaagacgtctggaatgaaaagctctgacactcctacgaaatccagaggtcgaacgcgagctgcacgacgttcaacgatggtttctgaggatgaggaagagaaggacagggagaagaaagattcagtgagagattctcctgcagatacagtgagctcttcttctgaggacgagcctgtggtggcagttccaaagaagagtccaaggagtatcagcgtcaaccccaccaccaagcctaccgcgaagaagactactgcagcagcctctaattccaagtcatctcccacccagactagaactcgcagatcgatggcgtcaaaggagaactctacaggagttttaacagaaacccccaccgcagtttccaagacggtgactccacgagttgctagtgcaaagtcgacaccgatacaaaccagccagtctcccatccagactagaactcgcagatcgatggcgtcaaaggagaactctacaggagtttcaacagaaacccccaccgcagtttccaagacggtgactccacgagttgctagtgcaaaatcgacaccgatacaaaccagccagtctcccatccagactagaactcgcagatcgatggcgtcaaaggagaactctacaggagtttcaaaagaaacccccaccgcagtttccaagacggtgactccacgagttgctagtgcaaagtcgacaccgatacaaactagccagtctcccatccagactagaactcgcagatcgatggcgtcaaaggagaactctacaggagtttcaaaagaaacccccaccgcagtttccaagacggtgactccacgagttgctagtgcaaagtcgacaccgatacaaactagccagtctcccatccagactagaactcgcagatcgatggcgtcaaaggagaactctacaggagtttcaaaagaaacccccaccgcagtttccaagacggtgactccacgagttgctagtgcaaagtcgacaccgatacaaaccagccagcccacatcaaactcgacctcaggcacttcgagttccaagcagaatcggttgtcttttgcttccaagtcgactccagggcccaagaggaccccagagaatgcaccttcgaattcgactccaaagtcgtcttcgcagacttcttcgaagacagtcactgagtcacctactcagaagactacaccaaggccagcttccaaggcgacgtccaaggcgacgtccaaggcgacgtccaacggcactccgaagtcagtctcctccaagacgacccccaaatcaaccccgtcagattccatgtctcggaaacgaccgactgaggaggctggatctgggtctggccggaagggcaagaagcagcgcaagtctgatgtcactcagaacggagtgtccaaggccgatacacccaccaagagaaaaaacagccagtctcgtccttcgctgggtcagagaattttgggattcttcaaatagccacccattgtacgatatcatactaatattatttgtaaattatgttcttactaccagtagtgccacactcaaacattcaacgtagccagttactaatccaccaaatcaccttgtacatgtgaatacacacatctttacttgctacttgctgacactacttttactgcaaggacccgctttgacattgcttactgtggtagctctactgtagaacgtagaaagtacagtacatacccctagaggagagtcacgtgacccaagatctggtgccgtttccttgacgtcacgtgtcatttcatcccatcgctttggatccaccggcggcttatctggtattcaaactcaatggaagttccgcggtcaattgggttgccatttgggtccccctcccatgcagttttctgtgccttgggggcgctaggtctgtggctctgttggaaggggcaggtgtaggaggcgattcacgtgacacaagggtgtgccttgcggggctctgttcgttttttcggcttaatattcagccgatcccgcaatctccacagctctcagattagccaaccacgccgttacagataagcctgagcagagatagcgccataatgaagctaaaagtctagttgtagtattgggagagttatagcgacaagttgttattagagaacgtcgatatggaggagggaagcttcaagcggccacgagaggacggttatcacgtgacttcttgctccaagtacatccgttgaggagctgttgtcgtgtacttgtagggggggacggtgtcggggtccatgcaagtttttttcatgcctgcaaaaagatttttttgtttttggccaaaaaaaaaaatttggacagcttcgcagctgcaggtgagtttatttttattccaacggctacatttttttccagtcgcttttttctctccctctcgaacaccagttccacaccaccacaccacacatcacacaccacacaccatgagcgacgtccaggtccccaccgacaagaagtacatctcgtacaacaacgtgcacaagctgtgccaggaggcagccgagaagatcaaggagttcaagcccgatctgatgattgccatcggtggaggaggattcatccccgcccgaatcctgcgaacccacattcgagtgcccggctcaaagaacatccccatccaggccattggtctgtctctgtacgaggagcttggcaccggccagctcgaggagcagattggagtcgaggtggtccgaacccagtggctcgacttctccactctggagaagcactccggagacctgatcggcaagaacattctcattgtcgacgaggtggacgacacccgaaccaccctgcactacgccgtctccgagctggagaaggatattgctgcccaggccaagaagctgggccgagaggacgagaagaccactctccacgttttcgttctgcacaacaaggacaagcccaagaaggctgagctccccaaggacatgatggactctggccgatacattgctgcccgaaccacccccgatgagtggatcgcctacccttgggaggctcgggatatcgaggagcacaccaagttcgccaagctgcagaacaacgattagatgtaatatagtatttaacagggctggagtagagccacagccaagccaagcaaacaaaacgacttgagcgtagcgagagtccaatagattgtcacacacagcagaaaccacctttttcttcatctcagtggacaagctgttgcagtgaaaaaagtcctgagggtctcttttccacactagcgtcatgaacgacaaaaaactgtgctaaaccattaactgccaaggggaacagttccagcgctacctctgcagtagctagtgaagtccacagaggctacagtagtgctgatccgagtgctagcagtagatggagctgatgtgagataatttactgtcccaagtacgaataatctgcgacggactgagattactccttgttatgccctttgtactgaccagctgaaagatcaattaacatcgtcatgtcttcaacctcttcacccttcagttagcgcttgtattttgagctatcctacaacatctacaagtccagggtacacattaacatcaattcaatatcaacaatctaacaccgtgtctcttgacactctataaatatgttatgggacagctctcttgggctgcttcattattcatcctcgccaacaaagtcctttcgcacaatgtccaagaacacctcttcaagagacgtaggacttaccgagtaatactcaatgcccagtcgctccttgttcttctccaacatggcgaagatggtcgacattttgttctcgtgtccggcagtcttgcatgggacagccagcttgatctgcccgtggtacatcttctcctccatctgggactgagggaacacctctctagtccactcagcaatattccacatctgctcatcagatgtgtagggcgcgttggaacacaccaagtgcacgtggaacaggtttccgtattgattacggagctctgccgcagacccaatcgccaaaaacctcttggcaagaatacctgctcggttggcaagcgcatcggcctcctccattgaatgggtagtcaacacaatacttcgtccatgggctacagatgacagagtacgccacatgattcgcttggcaaaggcatccattccagaagacggctcatccagcagcagcacctgagggtcggccatgagagcgactgccaaggacaactttcgcttgtttcctccggaaagagcgttggcagtagtctttcggaaccgatccagaccggtggctccaataatatgctccacattgtggtcacggtcctccttgctgagccctcgcaacatggcgtaaaactgcagagtttcagtcaccgacagcttgtccatagcgtcaaactggggacagacgccgagatgctgacgggcctgggctcggttggaagagacaggaataccggttacgtggatgccgccagacgacgggttctcctcacctcgaatcatgttgaaggtggtggtcttacccgctccgttgggacccagaagggcaaagcactcgtttggctgaactccataagtgacatcgtcaacgactcggttgcctccgtactttttagacacgtgtgacaacctgagaccttggttccatgactcgggattcgaatccacgtgctcggcctccttttggacgtcagagggagtcggcgatttggtttcttcatcctgatctctgtgtttgcctctgaaaacgaaccggaaacgtccagagtcccaccagactagaataccgtagaacacagcggcttgcacaatgagatacaaaataggacctccataggcgagaatgtcacccatgtaagaaatctcggagttgtctgaacgacacaaaacaccaaacagattcatggccacgaaaaacgctcgcacaagctggcaagtgggcgagaagatggagatggtgaaatggatggccctgacagtactgtccaccttccagggatcctcatacatgagtgtggacatgtatccaatcatgtagatgaggaagtagatggcattatagcccgcagtgatggcaaaagctgccagctgagacttgaccatgagagacacgacaaaggaaaatagagaagccgccaatgcgtacagcatgaacacaacaaacaagtatcctgctcccataacgtactccgaagagccaccgatgattccggtacaagctgcacctgtcagcatgagaggaacccagtcaaagatcgcataggcagtccaaaggggaaccacccttagtccattggaataatgcatagcacgcacacgcgaaagacgctcaaaagtagggtacagggctgcaaaagcgggcacaacactcattgtgagaccaaagtagacaatgaattggagagtatcgccggtggaagaagaccagggaatttggaagggggagaagtcagcatagattttgtagtcaccattctggcggacatttgtcaacagattcatcatcataacagaaaagtaagtaccatggccagtgttggtcagatatgcagcaatgggggcagaagagtctaggtacactcctccgggatagacctgggtgtagttggcgttcagataagcctcaaaagaactctgggtgtcggtgtagtgagttccgttgttcattttggccatgatcatgctctgtatcgtcgagttgcccattcctcggagcatacctccaatgaacgttctgactccctgagtagagtccatcaggacactctgggggccaacaggcatgtctagtggatcaacacccagtcggtaggtgttgtagacctgtcgtctgaatcgcgagtctccctcgcaggacgatcccttgaaagatctcaaaaactgagaggtggctccagcaacaatgatgggcagaatgaacatgacaatatgagccagggggtttcgcttgagaatgatgagccgcttgaccagcatggaccatgtctgatgcaacaagccggtagaagagcccttcttgagaccaccctcacccatttcggtgatctcggcatgctcaatgtggtctcgttccgccactcggaggaagacgtcctcaagctggggtccagctactcggtactccacacccttgtcttccaggtcttcaatttgttcagcaacctgtgcagcactttccaattcaacaatctcctctctacccgatcctggatgagagatgaagattcgatagccgcctccaagctgctccttgagctgaacagtggttccgtacacctgcagagttcccttggacatgatggcaatgttgtctccgagaatgtccgcctcgtccaggaaatgcgtcgtgagaagcatcgtgtgagaacctctgcttgaagtaataatctcccagatttttcgtcgggaaaggggatcaagtccagaagacacctcatcgatagcacatacgttggttcctccagcaaatgcaatggcaagctgcaacttacgcttctggcctccagacatggttcctgctcggtcatggcgcttcctgcttagatcacacttgtcaatcaagaactcgatagctgcaggaatttccttcttgggaacacccttgagctgtgtccaaatccgaagatgctcctcacaggtcaaagtgtcccagataacgttcttctgggggcagattccaactctggagcctggagaaaaggtgatggtaccgctggaaggcttttgaatgttggagatcatctccagagtggtggtctttccggaaccgtttgctcctagaaggcacacaatttgtccgttatgaacaggcaggttgagatggtccacggctgtaacagtgtttttgacccggccagtccatcgagatcggattttgtacgtcttggtcacatcctcaagcagaactctgtccttttgagattcgtcaatgttgatcttggaatgaactccatgcatgaaccgctcaacgatcatggcaaggaacaggtaaaagaagatggagaagatggcgccgaagaaaatcacaatcaccttgatgttggagtcaggcgcgttttccaccatgttggttccgatgtcttccttcttccatcgacctgtagtttggatgaagtaagggtagttcatgggtggaaacagaaacgacagaacgtagacagcagcgtctctaaaccttccttcgttgtttgggactcgagtctgaacggtactcatgatagccaagaaacaagacagaccagaggctacaataccggccagctgggcgtaagagaagaacatggagagaaacatagcccaggtgatcattgacatacccgagaaaatgtggtaaaagatgtaaatggccacatttgtgggtttcatcagcacaagattcaaagtaagagctatactgatccatccaggaaggtagacaatgctgaacgagatcagataggccagatgacgggtgaactgcttcacccccatagctgtaagcaaaccagaaataccatactctcgttcctgagctgccataccggccagatggtaaatgacaccaatcatgccgagaaacagggcaggagctaaccaatcaatcacaatctgaaggaatttggaaatcacattttgttcatgttgggtctgagactcgtcagtgtacgcgagagtgtaggggacagtagtttctcctgtgattgccttatccatttgccactgcagaggaaggatgaagatatctggatcagacttgtggcctccaatgtcagtcaaaatcaatccagagtttcctcggatggtgtagttataaatcttctgctcctcatcgatatggttccactggactcctccgtagcaggcggaatcacctcgcaggttctgactgcacacctggaacatgtcgttttcgtgttccaactcaaggatctgggagctggggatcccctccagagccgtgttcatgatccgacgcatctcatcggtgacacccaagggatcacgtgagtaatagatgatttttcgctcgcttaccacatctcgcagttgacgaactggagtgggatccgacacaccgtagttggcgtatggcgaatagaacgctttcgaatatgactgtgttagagacaaggaatgtggcatcaccatggataatgtcgtggccatcactatgaattggacgtgcactcgccctccgagaccatactcaccatgaaaacaatgaacgccacaggcagcagcgacgaccgaaagaaggtccaccaccacgatctcttgaacaccagcatgtgttttcgcaccaaggcgaccgtctggccaaacatagtcatttgcagatccacatcctccacggacgtctcgctgacgttgaacgacttggattccgggctggattgcaccgccagaatcgcggcatctttttccgacatttttcaaccccgaaatgagagacttgacggacctcgcaagttgcaaaaagtcgcacggcttgctttcagattccagacagacagagaagagacagtagggttggataacctaatgcaagatggcacagccttgtgcgacatgagaagtgacagacgaaattgaggggctaaaaatacggcagaaatttgtagtaaagcagataacaataaattaaaaaaggctggaatcaaaaatacagcctcaaaagcacagatttaccccgtttattgcccccaaatcgccccactagcccccaacatcaacgtctcaaaaatacgagcgtcctgtccttgtcaaagagtgtctcacaggctttattgtacgccctacacctgcactttgcatggtgctacgcttaaaatgaaaccctggaatgtgaagcgagatgaggtattttaacgggttggaaaaagaagcaaatggggttgctttttggaggcggatgatagccaacagaaccgaaatggccaaagaagatctcctccaatgggtctttgagcggctcggggtcgcttagaagaccgcaaaacactcttttcagccgctccaagcagtcttgtgaatcttggcgtcaccatgggttggcattggtggcggagtaaaatatattttgttgaggaggtgacaggagtggttgtatattggaagcaattcgttttttgtcgaacattttcaggagtagatttcagtgatttccctgtttctcctcttttctcctgaattttcccgatttattccaaacaattgaaatatattctttatcagaacgcgcagatctggagaaaggcgcatattgtgggggaaacattcttcattttgcgggaaaacacgcgttgatgacgtttgttgctcgttcgttcgtcgttcgtcgttcgtcgttcgtcgttctacgtgttcattaaacaaccacatggaatcatgagaggacgaacgcccttctccatcagtgtgatatacaaaacatattactctacaaaacggactctctaattgctgccgagatcaatcttccacacccactcatcaatgttggagatgactctctcttcaatctcatttccctttccactggccaccttcagaaccatctcgttcaactcagaacgccccagaatgtccacatgctcggcagtctgagcaccgcctcgaatatcaagtcgatcaggctggtgcaacatctccacaaccttgacctgggcgttaccagggttgaacttggaattctcgtccttccatcggtgacacatggtatgggtcacaagggagacggttccatcgccctggcccataagcacaccatcagggtcgtttccagcgatactgacgttcaagttggtctgctcgggattgggctcatcctggtagtagtaggctcgctcggtatccttaccgactccatagaagcagtagatcttgagatcgggggcattggggagagcagcttccagagggttgctccaggtagaaggtcgcttctcattctgctcaacctgctttcgagtcttggcaattccaaaggagtaagcaccctcggttcggttcacaaaccactcgggagactgagaatacaggaagtcaacggtttcatccatggtgaggttcttagcagagtactcggtcaaggactccttgaacttgatgaagttgccaaaggtgacattctggccaggctcgtcatcaggggctccagaatgatcaccccagatagccttaccacccttgggaatcatggaagcaattcctccccatgttcgcagcagatcggctcgctctcgtcgagagaagaactgctccagtccatacacagccatcgcgttcagctgcacggtatccttcatttctccagacagaagagcaaccagggtcttgggagtacccagcatggagccggaaatgtcgacaaaggattcaatatggtcattgacccagttgggacctcctcctccatatccctcggcctcagcccacttcatgaagtagaagatgacctgggagcccatggaatggcccgtcagaactgtcttctcacctgtcatacgcttagtctcttcgattgaagctttgagcttggagaagtatccgtctcggtgctccaaatcagggtaggacagtctccagtcgtacgccgcagcagacattgtatccgtatcgtatccaataacagccaggttctcgagcagcttgttccacagccagtagcctgccataaagaagtcggcggaggcaaatccctgggcggctcgcagcttgaaatggggagggtctagaccggtctctgtgtccagcatcaggttctgcagccagcagtacttgtccagcagcatgactcggatcatgtaccaggagccccacattcgctttctgaagtgcgactcggtgggacactcctcggttccctccagggaccagctctccagtcccgtggagatgacgccgggcaccagcaccaccgggtacttggcgttgagtccctcgctcttcatagccttgcccacagcaaaaggggcagccttctgttcgcttttctggtgcttctcgatcttggccgcctcctgcagaatcttggtcggaaaccgcgatttcatgtcttgtacaaagtccgacacactgtccatggacaagttgtcgagagatagagcgtcaaagtcgaacgagggcaagtcgccgagaagagcatcgatatcaatgctgagctccggtggcgcagcgtagtatcccgcggctatcacaccgaccacggcgccgaggacgaaggtgatacgtcgacttcgggtgaagaagttgagaatcttgcccttgacggattttcgcttgtggtggtgatgatggtggtgaacgtggacgtcggtcttggcctcggactcggagtcagccacctccactgctggctcgacccgctcgacagtcgccttccgattcacaggttgtgtcattgatggttgtgatcaaccggaaaaaagccgattacactttttttacatgagccagaccggggtagctgagacatgtcgcgtgaatgattagtcatggagcgagctgcgggagacaactgctagaaggataagccggaattgacgttcgtattcaattaaaattcgatactgtggcgattttagcggcgtttgtctgccgggcaaatcgagaatcccactatcatatgcgcgtttcggttattttgctggtgcatgaagagcataatattaataaatgtggggcgaacatgaaaaaagtgcggttggtactggaaatggatgtaaaaacagtcatggtcgaaccaaaagagtggtgccattgcttgtatttctgacttcatctgtacaaagaaatcgcgtcagaatggtcttgtttcagtggaccccgcagaatggtcctgtgtcagtggacaacagcaagacctcatgcaagggtaggtccaagcacagtatcaagctgctgtcgtatcgtacctactagagaactctggacacagcacttgtagcaaaggtcggtcagtactggagcttcggtgccatgggggatacgctgtcagttgtgtggagaagaagcagactccagattaagagaaccattctctaggtcatcgtaggtctcacagttggactggacgatatacgctgatttatcgtctgtgctgcattgaagggtcgtttctagggaggacagaggaagttactacaacgtacaagtagatgcattcagcagacttgacaaaccagagccgtcatccctccagatgacagggaacccattcttgaaggtcatgttcgacgctgcttggtcactgaatgtgtatggtatatccacggagatgtatcagtattacatgtaccaattgttatcaagtagtcaactccactgaaccactatagaaaaatgggggaaagatgaatgtggagcaagtctggttccacttctgtatcggaaagtcgactccagttttggagacttgagcggaggataatctacaagcaactgttaaatactttctacaaaagttcaaacttggctggaggagttgacagtctagagcactgggatcgatacaactcagcgcaccagagaacaaatacaagcagggaatcaagaactagccgacatctgttccagtctccgtggtttacatagatcaattattcataaatcgaatacagatactacactgtatacgacaaagagctacgtgcactcataaatcaagtataggcatcccgcgagcacgtgagtagaggcctactagacacaaagagagtcaatggtggtcatcgcaaacgacttccaaatgcatagcagttctgctcagatgcgcctcatgcccgcctttgatactgtatcgtatttctccatgtagagtagtattggcacagcacactcggaaggctgttgttatgataatgaggagaaccattataggggttatgacgtagggataaggaagggattgtcacttaaatttagcagccggaagtatagtggacagagctcaattgacagtctcttgttggggaaaacgcagtatgaatacggccaatcgcatgtatacatccccctgcaagtcaatgtctatctcctatccgttcaaatcagtgcaataccagacaaaaagcacaaagtcatctctcccgacatttcagaatcggctgattatctcttctcaatgtcacattgtgcgcaagttgctgaaatatgttagttttgcgaccctactaatgcaccagcccctgagatagaagaggctgtgttgatcaatagtgtacctgttcacttgtatgcaacaccgtttaaaaggaagggcaatgaattggttcgaagcagcatgcgtagaggagctgattttatgtcctgtttgataatctattggaacttccacccattattctaaccccattgtttttttttccaccagcaaaattgctggtaatttttcagcccttctgccaaacttaatcagagtgccgtttattaaacatgccgaaaatctgtggggtaattttaatatcaaaatttcaatttatccgacattgacgacatccacaacatgacagactactccactactccggtcgtagtgtctctcgaagagctgcaaagcggcgccaaagacagcctactgccttcggcctttggccccgactctctcggagtcattatcgtcacaggactgccaaaagactttgtttcgctgcgacaaaaggtgctgttgtcagcttctgatctggcagccctgccggccgacaaactggcggcaatggagcacgagccgagtttctggtgccagggctggtcccggggccgggaaaagctggccaatggcgtgcccgactttaacaagggctcgttctacgccaactgcgcgttccacaaagacccccaactcgaagcgccacccaaggaggagacggtgggatacgaagatatgcacatgtacaccgcacccaacatctggccccaagaggaggatctgccacagttccagaccaacctcaaggctctctgtaacctcattatcgacgtggccgaacatgtggcccgtgcatgcgacaggtacgtggctggacacgccaagatcgatggctacaccgccgggtacctggaggacgttgttcgcacttctacgaccaccaaggctcgattgttgcactactttccgatgcagcagcagcaggagcaggcagatactccagacgacgcttggtgcggcacccacaaggaccacagctgtctcactggtctgacatcagcaatgtttctggatggcaagactgtgctacccaaaagcccggatcccgaggccggtctgtacattcacaacagacatggcaaggtggtgcaagtgaagattcctgccgatgctctggctttccagaccggctccgccctcgaagcagccacccacggcgagttcaaggctgtgccgcactttgtcaagggcgccaatgttgctggggtgtcgaggaatacgcttgcggtcttttgccagccctccatgcatcgtcagttggggtccgaggggtcttttgctgagtactctaccaggattctggaggggaatcattgagagcatgcaaatgaaaagtcatagtttcccaaaataattatccaggatattctatagcccccgccctatagcaacaagttgacaaggtacagagttgatagacaaggcacagctacagtacaccatgtaaacagacacgtggagtacaacgaccacctcggactggctttgtctagactgaagtgtccgcatacgagcaacatgatcatgtgaacagtgcgtacatgaaacatgggtgggccgtatggctatatctgactccatgtaccgtgatggtacaatgtacagagtactgaaagcattcagcgatacatatggtcttgatacagtaaatcaagcaacagagaaatacactgcttgtatcccccggttgcttacacattcccctcaacgacatgttgctatttagttagggaatctatcattgctataataaacaacagtctatatttaatcttatatccctggtggtaggtggttagctccatggtctgatgacaagacaagacaagacggaccttttccggaagcgatcgaaacgacaaagtagctatatatactgttggtcttccgtgtagctgtcgacattgcaccattctggcttggcctcaatctcggtataggctgacattggaggaaggtataacattcggtctcaggtgtatactcagcccgagtgccgttgatatccgtccctgtcgtccgatattatttcgtcctgacatattatcaccgttgcaggcgtctttcaagtacacctcacattgctaggagatccaccgatactagcatctcagcatctcagcatctcagcatctcagcatctcagcatacatccatctgcaccatcaaaagataagagccgccacagccaaaagacaagcgaatcaagtcaacatcttcatcaattggtacctttccgacactgtccgtccgtctccgtttcccctcctttttgcaccgcccaccaaactccacaaagtggtctcccctggccaaactgccgtctccactagactattttaaccgacaccaagagtgtccgcgttcctggatttggcagaccatcacgctatccagataatttccgtcgatagcgctccacgtctgttggcttggtatttttcttttcttttcttttcttttcttttcttttcttttcgtccgtctatttttactctggagcccaccatctggagcccacccactccacctccaaggactgtatgctccaataacagcatctgcaattgagtgcacacagtacaagagtcgcacacacatacaagcacagaatatctgcgcatacgttttgctcgccttttcttttcgacacttcttctgcaaacaaccgcttccgtcatctaggggctgatctcttttagttacccctttctagaccacgcggccactctgagtttggcctcactccctgttctacgtctcctttgcaatagcgcgtttgacgtgagtctatccagcaattagacccgtttccggtaagtaccctaacccccgacccagacccacgcgttgcaacaatagaataagcttttcaattagcaatcccagacaggaaaagtaaacagttgggagacttgagagttgaggggggacggttgatggtggcgcaagagtcgattggcggcccgattctcgacgcgaaacagctttgagaggcttagtaagctgttggaaaccggcctccagctcgtctttggtctcccctaccgcctctctagcagtctcgctcctgcctccccctctgttcccctacccagccctactctgttccatctcagttaagctttggttccttgtgcacacgcgtgaaccgtgtgttgaaaccttaatctaacgtttagatattattaggatggatctttcccagttcgaatccttcaagtctcagacgacatttcggcttcacaagttggacccctttttccccgaccattccacccaccgccatcttcttccgcccagtccctctttatcttcctccagcacctccgtttccacgcctgcctccaactgtggtcccgacgtttacagcattttagggtgagtacgctgacaaaattgagtctcgaaaacggggctcaaaaatggagctcaaaaatggggctcaaaaatggagctcaaaaaatggggcttaaaaaaagaagaaaaaaaatctccctcgcatcggttgccgtcattatctgctcaatttgggaaggacacaaacagcagcgtcacatggcgtgtgtacaccgccgcctgcctgcctgcctttggacgacaaagtggttaattactgctcctgcgttgcatctcctatgtgcatggtgtccacactgtgcgatagaaaaattatcgtacattgtttgaagaggtcttaaacggtaaaaataggaggttttttcacaccccgtctattaggtgccccgtcctcttctcttctacaaagacgagaaagaaaagggaaaaaaggaagcagaaaaactaacacagaatctgccccgactcgtctcactcgctccttcatcctcatcataagctctctccacccttgtcccaaaccaccacacaaacacaaatgagtcttgctgctcctaaacctcttgctctgccagccttctacgactcgggatccaaaatgcctctcggccacgacgtgcccaaaaagcgacggggtcgtcctcgaaagcggcgtctcgacgccggcgactccttcagcagcgccacctcctcggacccttcctcctcccccctcctgtccaccgatggagccgctgcagccagaaccatggcctctcccaccaccaccccgaccaagaaacgcaaactgacggcgcctccgccacagctgtcgtcgtcgccacccatggctgcgctccgatcgttcgacacccccagcagcccgccaccacgaccacacactccaccagggtacgagacggtgctacacacccccaagcagctgtccaaacatcaccacaacgccagtaatcacacaggccaaccgaccaccgccactaacgaaaccccccgaagccgaacgctggcccgattcgagacgtcgtcccacgtgaacccgtcgctcatctacgcctcggccacccaacccatgccttcggcgtccttctcggacctcccgtcgtcccccacctttgcatcttcctcttccatcatgtcgccacagacgccccgcaacggcttctccttctccaccatcatggcctcgtcgccgctgtaccacggctactttacgtcgccggcccagaacgactctcctggaggctcgggcctggtcaagctgtccgtcaaacccatgcccatgccctcgttcaagaaggacgccgagcagctgtcagatccgttcaagaactaccaggtgcgctcgggacccctcggcggccccctgcagcccctggagcagtcgcccgtgcagatcaagcggctggagatcaagcgacgcatctcgctcaacatttccgccactggaaaggcctcggtggggatcgcagacgagcgccctcctcacatgactcggtcatactacacggatccggaccgcgagaacatcgacaagcttttccccgagctgtcgcctcgacaggttgttcccgaagacgacgacgactcgagcgacgatgacgacgacgacacacgcatcggacctggttccagccgccgatctgagagccaggatcctctcagcgatgccaaggccgctcttcagtccatgatgaagagcgggcggaccagcacttctcaggctgcctctcgagcaggcagtccccctcagtggagcattttgcattagtcatatacaagtactacaagtcaagtagataatttattggagttttaagatgtcagatcgggtattgtagcattgttgtatatcggggtcatcacgagatggctcattatggggcttacatgggctgggtaggtgcagttttcaatatgccggttccagaccattgtacagtgagaatatgatctataaaatgtgttctctcttacttactaatcatctacgtgttattacatattatggaccgactatcgtacgtacgatattgtaatcagccccatgttgtgagagatggagcatcgcatcattgtgcctcaaaaacgggactgcagtattcatgtgcctggatatgttggtctactgtacatacatgttttttgtcgggggcacggccgcgggtagcgccgaaatggtcgtttggagtgagctctgggttctcaatggattcaattgcaccagttggatggttatgatcaagtgagtactccattgccggcctgctactgtaattataactagtagtcatttcgaacgtcacactttagcctgtgtctcaccagacaaaggacgggccctgcattatcgcaactttaaagacgataaatcgacatggtcattggtgtactgtagatggagggcgaaaaaaagatgtggagcatcagaacaaagtggttggtgtatgatgactaatctgggatctggatggcccaagacaatcccttttggtcacagaaccgggttgccgtttgttcccgtcaaattccgagtgtggtggtgtcgttgttgtgactgacaccacgcatcatctcaatgtattaagcatggcactttctgtgtcaccttgtgtatgtcactacataaccctattatgtctgtgttaatattttcatggctatataagagcccctcctcttgcgccgcgttcttccttcctcttcccaatcacatcacatcttcttcccccactcagaccagcagctcgctttccaccacccagccacccccacagctagctcctgaccatgcccaagaccagccctactaccactcctccccctgcggataccccctgtgatacagcctctgttaccaagggctttgcttccctgattgtctccagcgagggtgagatcgttttttgctttacctgtcacaacacccgcgttgtcacaacctcctaacacagccgacctcaaagacaagacgctcgatgtccttagcgaccacgacgacaccgctgacaacagcatcctagacgaccccgagcccaactcgttcacctcggactctctcactgctgccgagcccgagaccagagaagatgacaagggaaccccgtactaccccaaccaggaacgaccgtcgcggccgtcgtcgtgtgtgtttgtggccagcttgaacgccaccctcaccgacgaccagctcaacaattcggtcacccgccactttgcccagtggggctccattgccttcgtcaaggtcctccgagacctgtgcgagcggccctacgcctttgtccagttcaacaccgacgacgacgccaagaacgccattgccaagggtcagggaacctacctcgacaaccgctacattcgttgcgagcctgctcgagtcaaccgaaccctctttgtttaccaaaacccatccaccacgtctcccgtaagtatcccccccctccgatgatgtcacgacgactgaaacatccttactaacctagcaactcaaaagctatctcgaggagtttggagaggtcgaagatctcgtcaatacctgtgttcgatccagatcgtccgaaaccaaccgaggttggtttgctcgctttgcttaccgatccgatgccatcaaggcttacctccatatccgaacccagggtgatttcgaggttgagtgggcccaaaacctcaacaatgacttcagcaagaccactgtcaccacggtcgaccccaagtccatcttcattggccagctgaaccccgccaccacccccgaagacctgcgggctgtgtttggccggcatggcaccattgtctcctgccagatccagttcaaggagcgggacaggacctcttccatcaagacgcttgctcggcggccgtctgcatttgcctttgtctcctacgaagaaccctcctccgccgacgctgccgttgagaaggagaaccacagcattctccggaaccacacaatccatgtccagtataaggaggtccagcaccagaagaccaaccccaaccacctgcccacgttggagtttgccccccctcccgtgaacatcccggccctgggccggcaacagcaccagccgcggcggcaccactctctgcctttgtacaatgctggcaaccctccctctggtccccgacagcgtggtttttccatgtatggccagccgcccaaaggtcaggatgttgacagccatccgtcggacaagccccaggaggctgacggggaccccaagcccaaggtcaacattggcacacccttctaccccagacagccgcgggctgtgtcctacggaggaggtggggggctgcagaacagccggtgggctcctcagggccaataccggatggacaaggacaaccactaccaccacaaccctcaccaccactacggaggcaacgggtatcgaggaggcggtggtggatacggcggtcgacgtcactaccggcccaaggcttacgggcctactccggtgccctactacgtggactaccaggactggtatgctcccaatggccctcacatggcggcgggcgcaggatattacgtggacccgcccatgtctcagaagccccatgtccgaggggacggtggacaccacaactagacgggttctgcagtgtccctgctgattgctagatagagaggtgttttgtgcttaccgtgtagacgtgtcatgcggggcagtgttgttgcacatgtcccgtgcgtctggggtctcagaacaggtcttgttttgatctgttgtggccgatttgtgtttagtgtatttaagtgtaaataaaaattgatcaagcgaaagccagattatgtaggaggtgttggaggggtgggaggggtgggaggggtgggaggagctataggagagtctgtgggcgtggtgtggccaagccccccacccccctactgacggcaggtgcatgattgcttgtattgttcttgtgagtaggttgcgcagtggcaaaataggcgcctattggtgttggcatgcgggctggtggagccgtccatgtgattgcagcatactgccacagggtgaccacacccgctgccggacactctcccgggaaactcgtggggaatgcatgtatggcgcgtgttgggtgcgtatcttccttaggagtgtacatcaaacaccctgtaggctgaaagttgagcgtgtgaccatattttagcgtgaaaaaatcagagtttacagatagcggtaaattctattaaaaaaaattacggcgcaaatcttttggtcttttgggcgacggcgagagaaaaataggcttggtgaaaaggcgctactgtgctactctcaagctatcggcggttgtggacttctgcagtgtgggcgttggagcgttggagagcgcccaaaaagggctgtgcacgtgacagtccaggggctatctgtcggtctatcgagtcccatgtctgctatccgagttgggctcttgtttttttgtggggtctttgtcgccgcaacacctgaagtatattgacggtgggttatctattggacctgggttttttttttttgccgggaaattaagcttttgattgacctgctaagcaacaaaaggtttgcgggatgaaccagggaaaaaaaagggcttttgcacacctcttttagacgtcagtaggtctcagccaggtactagtagcgaccttgtgggtgttgatttgaggcgccttcccccgatctccgcagctattcaagaaacggcccgcgagctcgtaaatccgacagataaacaaacccccctgcctgctgttgctgtctcgcatatctgacgctgacgccattactctgctgtctgcaccagagatccgacgtcaacttcccaagcactcgattgcctgatatttgcgctgaatggcccctcaacccgaccaaagctccatgtttgtcacctctccacagacccagccggacgacagtccgctgatgacgccgctggcggtcccccagcacgcgggactcagccaggcgatttccaagctcagtctcaacaccaaggcccccggcaccgtcgagaagcccgtgcgacctccgctggcgacgcgggtgtcgggtccacacattaagctgcgacggttttcgggcaccaagagcgagcactcgtctgccggcgaggaggatctacccccgccaaacgtgaattttttcctcgataaccgactccccacggagtacttcaagcaggatatcctcatgttgatccataccctcaagattcccaagtggaagtacgtggagagcaccatggccgccgacatggtggtcacccgactgtctggtgcgctcaccaacgccgtctaccacgttgctcccccgacatacctcaaggagcggctgcgagaagccaacgaaggctttgtggccaaacacaggctgccgctgcctctgctgctacgagtgtacggcccccaggttgagcatctcatcgaccgggactcggagctgcgaattctgcagcgtctgggacgaaagaacattggacccaagatgatgggcacctttaccaacggccggttcgagcagttcttccacgcaaagaccctgtccaaggaagatctcagagacccagacacttctgtgcagattgccaagcgaatgcgagagctgcacgaccacgtgcgactgcttcctgaagagcgaatgtctggccccggagtgtgggtcaactttgaaaagtggggcgtgcgagccaaggaggtgcttgagattctcgataaccgggccaagaccaaccctgccgccgaatggacttgccagaccgttgtgcagagctcctgggacgaattcctgaccatggttgccaagtaccgaagctggctggagcacaagcatggaggcgccgagtccatcaacaagaagctcgtctttgcccacaacgatacacagtacggcaatctgctgcgtctggagcccccgccaggctctcctctgctgcaacctcagctggagcacagacagctcattgtcattgactttgagtacgcatcccccaacgcccgaggctttgatatctgtaaccacttttgcgagtggatgtccgactaccacgatgctcagcatcccgaaaccattcatgagaaggcctatcctaccgtcaaggagcagctcaaccttctcaacggctacgtggagcatggtctggagtcctttgatgacgaggaccagatccaggtcgaggtggacggactcatggaagaggtgcgtgactggcgacccgccgtgcacctctactggctcgtgtggggtattgtgcaggctgtgattgaccaggaggaagacgatgagatccgagaggagctgaacatggaaactggccagtacacgtttgagaccgaggaggagaagcagcaattgtccgcgtcttccggctcttctgccaatctcaaaccgtccgtgagtcactcatctgcttcggaagtggaagaggaggaagacccctttgactacctcagctacgcgtcccagaaggcccaactcttctggagcgacatgatcagattcgggctcttggacgagaaagactacaagggagtcacccggtttattaatgcgtagatactggacgcaaccaaacacggggtgtcacaaaatgaaaaataacgctaatgtagataatcaatgtatattaaggatggcttctctagatgtacgctctacgctccgcgcctgtatgtcctccactcgcatttacgtacactcgaaccaaatcagtagacctttattcattatcagtcgttcacttgcgtcattcaattatatataagttacataaggagcatctttcgaggatcctcaatgagctccttgatagttcggaggaaaacgacagcctcacgaccatcgagaactcggtgatcgtaggtcaatgcaaggtacatcattggtcgagaaacaacctggccgtcaacaacgacagctcggtccttgacaccatgcagaccgagaacggcagtctggggcatgttaatgatgggggtaccgaagagagagccaaaaacaccaccgttggagatggtgaaggttccgccggccatatcctcaagagtgatcttgttgtctcgggccttgacaccgaggtcgtgaatggccttctcaatgcccatgacgtcgagctggtcaacgtttcggacaacgggggtcaccagacccttgggggtggcgacggcgacagaaatgtcaacgtagtctcggtagacaatggtgtcaccaccgttggggccctcaatggcagcgttgacggcaggaacgtctcgcatggccagagcggcggccttggagaaggcacccatgaaaccaagcttggtgccggtcttcttgagcatctcatccttgtagagctttcgcatctccatcagagaggacatgtcgacctcgttgaaggtggtcagagaagcggcggtgttctgggactccttgagtcgctcagcaattcgaagtcgcattcggttcatcttgactcgctcctcctttcggaagccgccgagaccctcggtggcatcggtcttcttctcctccttgggagcgggcttcttctcctccttcttgggagcaggggcagactcctccttcttgggggcctcctccttcttaggggcaggggcagactcctccttgggagcaggctcctccttctcctccgtcttctcctccttcttctccttgggaggcttggagccaccgctgctggagccctcgcctcgctcaatcttgagaagaggctggccgacagtgacggtgtcgtcgggcttgaccaggaactcggtgatggttccggcgaagggagcgttgacggcaacatcaatcttatcggtctcgatggtggcgatctcctcatcggcctcgacaaagtctccaatgtccttctcaaaggcggtcagagtaccctcagtcagagactcggccatgggaggcacctcaacaacgtcggcgtatcctcgggacagcagaacaggcttgaaggtcatgacggtgggtcgagtgacctgagcggtcatggagggagccttgagcgtttgtcttagcatggatgtggaggcggcggaagacagcattcttcgcgacgaggcggaggccattcgcatggattgggatctgattgttctaagcatctggggttagtcatggggtgagtagaaaggtgatggaaaagtcgttgtcacagagtgccatggtgcttgtgttcatgttcgtatttgtgtcacaacactgtgcgggttgtgtgtctgtgtaatgtgttgtcatttaaaggtgctgtgattcgcagcttctttgccactgttttgtatcggacacagcaaacagaacatgttgagggcccaagagacttgcaatgacacaataacattggttatgtgccattgaaaccacctgtgatgcctcaccagccctggctcttccctgagagcattgcccggagctatcgcatgagggactcaagagagaaacgggctccgacagagcacgggagaaagcgtgcgaccagcactctatggggccggcaattgcggcttgtcgttcccagtcctccaattggcgtccggagccccaccagcatccaacgtgttcactcaccttgggtcaagaaaatttacagtcgtggaggtaggagcgctgcagttataagcaagcgatggaaaagctacttggttggtctttgttctggggtgggagggtaaggggatttattgcgcagtaattggccaaaacctaaatagaaactccggcacgcattccggaagaattcgggcgccttttactatgcggcaatttacagcgaggagaaagacagacagaagaaaacagaggagcgacagagagcggcgagcaaaactgttagccaccacggtctgagagagacaaggggggaagaaaaaaaactaatctgggggaaagggcacgtgttgcgagtcatttgtttgagtcatccggaagatcgtgagtcatgccagggtgggtgggttatcaagatggagagatgtgcccatagtggcgctgtggatcttgacattacacggctactactgctgtacagcaccagctataagagtgtggggaggttcagccgtccacagcacaacagacaggccaagagatgccattcccccctgcaatgcgcacatacgtactcaacaaatgcacggaaagaaaccgggtgggtggtgatgtacgtacagtaccaggagcgatcgggacaatagtcgatttttgcaggcatatacatgtgcgcggagctacaagtatggtccaccatctgcctgtatgaaacatcaccgctatgcagatcaatcacatcctactaagggttgtattggttgatatgattgatacgttggtggctatgattttgcgggttcgatttcagatggaaaatgcactagttggaaaagtactacttgtactcgcgaaaaccggaccaacaagccgctacctgtatcgtcaagaggtgcacgccattgggtttgacagttgctagtgccaaccttggccgttccgacttgatccggtctccagctgtgagatatatagtccttgagaccacagcaacgtcttgctttgatgtttcccggtccctttgcctttctctctcgctctctctctcttccggataccgtttgattatctccgatccatctctccaggtccagattccagaatgaatgcaaagttataacctaaacggaggagcttttgtcctgtctacagcagcacgaacaccgttgaacttggcgttgggcgaggctggggggggatgtttgaggcgatattccgcaagtttggggacctgcagatgtgcctgacgtctagctcaacccgtatctacccagcaataccctccttgctctctctgagacatgctagattgcaactcaattggtcatctacaaatagtccgtactgcagcagctgatgcgtgttacggagaaagctttcccaatttaaccgcaaatgcatggggcatgggggtcgactgggaggactgttgttgctgttgtggtgtgggtggagagactctgaggagcgggttttgcttgtagccacgagtttagtcagctggcaaaaaatggggcttctagctctactatgggtcgacttagaacaatcttctgctgcttcgtacaagctcaagaaaccactgtatcaatatgtaacgatatgaatggacctaaaatgagacatggacggaccggtttttgctgaagataccgtcccgcggtagctaaatggtagtttacttgattccgagagattctggtaccctctccagttttatcagatttaatttgattttgtccgaattgatcggatttttccccaataatcaaaaaataaacttattaaaaaataaaaattaaaaattaaaaaactaattaaaaaaaatacaaagtttgtcactctaccagctacctgactaagctataatagcttgcaccaccactccaagtacctccgcgctacacccatgaaagtggacaagccaggaccgaggaaaaaaccgctgccaccactcccgtcttctttctaccacctgtacacctccaagcccgcgtcacagctcgacgccagctgcgaaaccgataagaatggaaaagtaagagcccttcctcacattgagggccagtggcctacacatgtgtacctggaatggaagccggacgtggcctggagacgtctcgagatgctcaatggggctattgccaaggtgctagagacctaccaagtggtctaccacagcctggccaagtctgacgttggagtacgactacctctgcatgtatctctttccgacactctgatgcccaccaccgaaagcaaacagcaagtgacggacagcatttgcgaggctgttacggggtggaagggccccatcaagatcaatgtgtccaagacaaagttacaggtggtgttgaaccggcagaaaacacgtgcgtttgtggtcctagctctgaccgacaatgagcccatagtgcgtctgatcgcggccgtcaatgcagccgtggagcctcacgggctgccagcgttggctgcgcatcctcacgtgtccataggatggtttcttccgagagcagaccccgatcccgtttcagacgcgatagtcacgagtccggagacagacagacatttgactgcccttttcggtaaagtgactttcgactgtgtgaaaatcaagtgtggaaggttagtacagtccgtgcgctgtatatagaaggatggagcctatgcatcttgctacaccccacgccggatcgaagatagttgcgccaatccacacatggtggtttgtacagtttgagtgataatcctacagtggtgatgtagcatcatctgaggtagtgtcggtacggtacggtacggtacggtacggtacggcggttcgagtacgagtagcaaccgccaaccaacgagacccgctactggaggagtctttgttcaactacctgcgacgagaccccaaacacacgtcatatagtcaatcaacgccctgctttcacgtttgttctccgctgtacacgtcaagctacaacccacgcgaaataacctccgaatacaccattatcaagattcggggcctacagcccatacagcaccgaggggtttttagggggtaaataaggtttttcactccctttaagctcgcacgacgtgttgtgtctatacccaaacgggtaatacccatacgaaccgcccatcgcacctcacctccagacagtatatgtacaatgggggatcccacagcgagattgtacagctctagaaccacagacagtcaaatccttgcgggcaggggtcctccatctacagaaattcgcatcacttcacacacagtcaatctccagatcacctccatcaccttgatacacattcacactccacaatgaacttcgactatgactttctgcagtcgcagcagagtcttcatatgaagaaggagcatcattcacagcagcatcagaaccagcagtcgtcggcccaaccgcaccatccccaccaaggatcacagtacgatgtcaactacctggacattggctacaacgagctggagcctccgtctaccccccagatgatgcctacacagaccaacaatgtgagtcccgacaccctggcgcggttctcgcgactgctcaacttctcctccaccacccccagtcccaccaagccgctcaatgacccctcacaatcggacattttcctccagcagccccccaccatgtcgctgatgggagccatgtctccgcctcactcgtcccaccctccggctgccgagtttggccatgctcactcgtcccatcttcagcagaaccccttcctgaaccctccccagctcaactacgatgccgacgctctggcctacctgtctcccgagccaggcttcacttctcctgaaatggacaactggaacaactacgagtctccccatgaccactcctctcccgagggaccccttggagaaccctttgacgagtacggactcggaatctcgtggctgcccgtcgtcaccatccccgaaaacacagaaacagagcagatcatcgaacagcaaaaggtctccaaccagcctcagcctcgaaagtccggcctaccccccggaaaactcgagtcgttcattcatgggccctgcgaagacggcaagtttctgtgtctgtacccgggctgtggcaagaagtttggacgacgatacaacctctgttcgcacatccagacccaccttgcagacagaccgtactcgtgctcgtcctgtgaagcctccttcgtcagacagcacgatctcaagagacacgagcgcacccacgccgtagtcaagccccacatttgtccctgcggaaagggcttcaatcgaccagacgccctcaaccgacacagagcccgacagatctgctctggaggcatcgaggtacctggccaacccaagccatcgccaggcaaaaagggccgaccccgaaaggtcgaacaaccgatccagatggaacactatgattatgcacacacctctcccgacttttcgtctccagagtaccactcttcaccggacttcgaaggacattaggaaacagtgagatacagaacgagaaagagagagagagagagcactaacatatatttataatgtggattggttttgtttatatgcttcattccttcattctatatactatttattacatttaattgagtcaattcaaggagttattacattgcatctacacagctatcgcgatatcatatcatcaccccacccgcacagctcatacagtgcccccttgaaactttttagctccaaagaacatgtattccactgtatcgtacaaccacgtctcactaacgcaagatacggggtcgcatgcaagggagtggtgtacttgagacaatacagtgtatagacactactgtataactcccagctcgacaatccaacaatacaaattaatcttacaacattacttaaccctaagaggaggcagccacagacaacttctgaagatgagacatgaaagtctgcagagacacatcgtcagtaagcaccacggcgctgccaggagtgccgtagccactgtcgctctggtgggtgttggagggattgagcttggacagcaagaaacgggcctgggaacctccagcatcagtgtcaatgaatcgaggcaaagggaatcggtcaaccagcaagtcctggacctccattcgaggggcctgcagaagctcagcaaagttggcgtactcctccttttcttggtagccctggtttcgccagttggcaatggtttctccgtggaaaatgagaatgtggaaaaaggtgtccagcagcagaatgtgatcgggcttgatggacaccgaatccagcagtacaggcacgggctgctcctgctccagagagtacgacagcagggtgggctggatcatgataagcgagttgttgagattctctcggttcaggcagtgtcggtagaaggcagtctcatcgggcgagttgttgaacacctgcaggaactgcgatcgtcgtagatggaacataaactgggggtacagcgagaagttgtgggcgagtcggaacgaagacgcgtcgtcttttctgtagtcagcaaacttttggcatagacggatcagcatcttgtcggtccatcgcataatgtcgttgccgtcctcggtctcggacttgaaaatggcaattcgagtcataagcacagcagcagcctcctggtcaaaggagctggcaatgtggggatcgccaccgggcacaagagccttggcaacagtggtcacacgaagacgttgctgagtggacgagtggtggtaatgcgtcaggaactgcacgtatccaggggggatctggcctgcaggagtgccctgctgctgggccacttcgaaaaaagtcgcgtaggtgtgagcaggagtgatggagcacatcttccacgaagaagtctggccaataccaatctcggtgtcagctacactggggttcttcttgttcattgaaacggcgtggccaatcagaccagataccttgagctccttggagggcacgacatcaaaggtggcgttgaaacccatctggaggaagttgttggcgtctcgggcaaacatcttggtcagcgaggacttgaagatggatgtggagaaggcatcgcagagcacaagagctccaccggtggagttgggcagagatcgcatctcgtgcataccaatctggtcgtaacaaccggcgaaaatgtcaacggcctggccatgggtggtggctcgcttggccagaccctcgtagaactttgtggcagccttggagtgcttggctgtgtccttttcaatttcgtggtgagatcggatgggctccttgagctcgggacccacaatcataccaggaccctcagtgggggcaccaccagcaaacagcatgactcgtgcaccgcagttgggaaaggaagtctccagcaggccgagagcaattccgagagccacaccggtacatcggatgggtcgtcggtcggcagccacgggccaggggtccttctgcagaccctccagaacgttggtgagggcgaactcggcgttctgcagaggcaggaggaaccgggcagcggctccctgggcctggggatgtcctccctgttgggggactcggtgaccaataggctggttgagacccagctgttcctgcacctgcttcgcagtgtaatctcggttacctcggaagacgaagctcttgccgcactctcggtagccaatctcgtggacctgagccatggcgccaaaggtgatgagaccgacgagagcgttctcggggatcagagaaagagtggccacaaggtgatccttgagagcagtcaggttctcggcgtccagacaggtgtcaaccacaaacaggaagatggggttgggagcaggtcgggacagaacgtactcaacagtggtgcactcgggtcgcagctcgtggggcaagttttcgggagtaatgtctcggtactgaggaggcagctggtttctagacagacagaaaggacagacccaggctcgggctcgcagatcaacctggcagaaggagttgagcacagctcgacaggggggtcggcatgcaatgggctcatactgcagtacggggaggttgggcttctccttcagaggagtgtacagagccgagatgggaacgacggttctggaagcctcaattcgggtagagggaatgcaattccaggagaatcgcactccgtccttctcttcgaattcttcaaagtcctgggttagtacgaaacggaaacgggtaacgggagtagccgcaggtcgaggacgacgcgcgacgtgaccatgcgtgtcacttgccatcgcagtggaagacaccacctggatccaagcggaagcaagtagctgtagttgcaatcacggcacaacagcgcgccaagctgacaccgttacgtgatgttaggtaggccacgaaaagcacatggacacaaacacagcgtagcgtaccagctccaagctgctgacacagaaacaatcagtatacttgtcacacaattgtaacattgtcacaaactgccacatcaatgtttgtactaaacaccgtgtaacgggcacacgaatacctgtcctagtcggttgataaaatggctgattcaatagtgcaacactggcgcaaagatcacgtcatccagaggtcctaatcacattgctttcgtctgtgtcacaccatctcttctgtgtcttttgttgctcatcaaatccatcccccgtgtcttttcatattggcgatcaaccccacactaagggattcgattggtcggtttgcaagagacacggagccatgtgtcggccatcggtttgtgtcatcaaatcaacccagttcgccagcatcgcccatcgcgtcgccttgtcacactcaccatttgattgttgtgtcgaataggccacctaagcaaagtgaactcaatgttgaaaatgccaggtcgttggtaacaggtgggacattcacgtccgaacctaaatgagtggtgggagaatgtgtgacaacgacaagagtgggaatggagggtctatatatagggaatattttggtaacgacaagacgaatgtaatgcggaaattggaatgcagatgcacgatgattattcagggccaaaaatcatcctgtctagcgccacccaactgcccacattcagacctcctcaccccaactaacacgtcttacgtacacacttactgtaacttcctccacacctaattcacgtacagtacaaacttgtgcatacaagacaagaacaagagacacacattgtcaataccgcacgtctgtcaaacccacagaaagacacccacggcaggattctcaacgatggaagtcgccactctcgcctgtggagcaattgctcggatagtggtctaccacctattcccgtccgtgcccgcaactctagatggccatgtggaaatctccacgcccgtcacctccttcaaacgactccaggagggcctgtatctctacaagcaaggaatcgatccctacgacggcggaatcttccaccagtcgccactgctgctcggcgcagtgtcggctgtgtcgaaaatcgtgcccgaaaccatcgcaatcaacattctatacgtgctggcggacctgacggcggcatgggccctcgctcaaaccgcccagagagccgccaccaccatcaaatacgtcttcaagaagaaagatacaaaagagccgctgccgtttgctccttggatcatcgcagcaatctacctcttcaaccccctgctgtttctgtcgtcggcagctaaatccacagctgtgttcaacaacgctgccatctgctacaccctggccgctgccacccacggccactttctgactgcagccgcctctcttgcattggccactaacctttcatattaccccatctacctggctcctcttgtgtctctcctgctccatggaaacagcggaacgccactcagaacaaacaaggcccagtacggcttccggttctgcctgctgtcggcttcttacaccgcagctatcctgctgctgtcccaggccattgctggatcctggaacttcctaggagctgtctatggtactattcttactggtagagacctcactcctaacattggcttgtggtggtactttttcacggagatgtttgacttctttcagcccttcttcaccggagtgttccaaatccacgtctttctctacgccgcccccatcactcttagattcagcagcttccctctgtttgccatcactctctatctcggtctggtggccctgttcaaggcctaccccgatactgccgatgtgggcatcttcttctcgctggtgcccttcttcagaccgcttttcccgcttctgaggtaccccattccggcttttctggcgctgctatactcttcggtgctgctgcccaccttcttccacatgtggatctacctgggctcaggaaacgcaaacttcttctacgccatcacgctggtgtatgcgcttggaatgaccgtgtgcatttccgaccttacttgggccatgcttcgcctggaacatgacggaggagaggaccccaacctgtcccaaatctagatatcattaatgaaacgaattatgaataagaatgatcatgacacgaatggaagcatgtatagtacctgtacaatgtactcgtatgaatatgaatatgcacaaaaaaaagccgacaaatgctttgctcggaaaggcaaaaaattctgggcccaaccgggaattgaacccgggacctctcgcaaattgcctaggacaccctaagcgagaattataccactaaaccatcgggccagattttttcataaaaatgcaagtattgacggtcgctcgacccagaaagtcacgtgaccggctttatgaactcaaatgaggcaaccattggtttctttttcctccgcggtctctttctttcggcatctaagcagcaagccagcggcatgtttacctgacccggttgaatgctcgatgcccacctttggtgtctggttgctttttgtgaggagaaaatgtcgcttgtggaagagcaatacatactgtaccattgataactgagtgcgtatgcggaaacagtcgggtggtgagtctttttggtgcgtatggttcagatttgattgacgcagagttggccattgtgtgaaaaacttgttccttgtcgatgaggactgtcatcgaagacttgtgatcaaaaaaatgttaatcagtgggtggttatccaacaagagcctgggcaagccgttgtattgtatggcgagcgatgatttttgattggccgattgtgatagtcgcgggcttcgaatatctgctgattgtcgatctttctttggactatctacgttttgggcgccgagcactctagacatgtgggagtcatgcggcaagaggattaacctaccaacaggacagctgaccgatgcactgcctcccagagtggtttatactggcagattagcgatatccactaactgagtaccggtgatttagtttaccgccgttagtttatccctcaggcttccaggcttcaatggtctgatgtgctgcgatacggtacaagcgagtctctttacctcagaattagagcagagacaatagtttgtgtggccttagttttttccacacagtatcgagccactcacaagagaaggaagcttgggggctctagggtttgtgggggtcactggacgaggagggagatcagtgggtggtggccatgagtcggggcagcaggagatgatccatagaccgtgagtttcgatctctactgtgtttgtcggaaatttcaccactctcgagaagtaaaagaagctcgaagctagggttagaagaaggtctagcgaacgtatacgtaccgtggagtggagtgtatgagcgtaatattgtagatctacattgaaaattacccctttgggaataatgcagttcccgcaaccttgttcctgggggaagtcttacaatagcgagtcgagaagtgtgggttcaaaattttattctgatagttatggaagcttaaagagttgagaagaagtaatagatagggccggaaaccagtcgggccattgttagtcagtagaaataacttactgagcagaagagggaggcagcttggaggagacctcggagccaagagaagaggtggcagagtccagagagccaagagcatcaccaaggttgtggaagatcttcttgaaggcatcggtgagcagaccaatgttggcaagcagagtctggaagatcttggcggggttctggatggtgttgaaggcatcaacggggagagaggcaagagtggcgccaatggtctcgacaatcagagccagggtcttgaagatggggttgacaacgatggagccaagagttccggcaataccggaaatgacggggaggttaaggccgttgatgtccttgatcagagcagggatctgcttgttgagggagtcaagagcagtctcgaggttctggagctgggtgcccttggaggtgttggtgagaacaccaagggtgccggtgatggcagagaggaaggtctcggcaatgtggatgagatcgtcagcaacatcgagctgtcggatctccattcgctggaaaccaccgttagcggcgggggcggcgacaaccacagaggtggcagcggcgaggatagcgatgttcttgatggcaaccattgtaagagattagagggtggtgttcttgaagaagaagagaagagggtagagaagtgaagagaggagttgaagctgtttgctgatgagacaagagggaacctgaacctgtatttatattcttttgagagagacagtagcgtcgatgtcagtctcatcaagtctcgcctccactttgtgcttttccccagaacctccacccaaacctacctctcggaccactgtacaattgcgacattggatggcggatttgacaaagagtgtctatcgacgttggtttagcggcaatgtgagtttgcttcggccaagctcagggattgtctgacttggaccaaccagtctcacactggtctttcacccaaacaagcttctttgaggtcttccagggccatggaaagttgtgattggacacgacaagttcacagacatgtagctaggagtatttcaaccctttatctcaagttcccaccctcttatcagtgattccgccctttacgtcatgtggttaaagtgataccatctcaaccttggataaagcatgaacgataaccgccacagcgcattttctttgttcttacatgttcatacacttgaaaacaagagagttatccactttaaacatccttcccggccaatttgatccgtgtagctgcactgtactgcgtcgaacatgtctgtgaaagtggaggttcctgcttgagacatgtgctgtgtatctgactgcatttgaaagtcggggctacccaaggacagagtggaattccccacagaagaatccaagttccggagcgtttgctcggacctttggttggtcaacacactaccgtttgttcagtcacttagtttcccctaaaggtatatgacaaccttcttgaccgctagcttctgttcatgcaagtgtgcaccagtgatctgcgttggtgatcgcccgtagaccgccgattggctagtcggcctcgatcagcagctcgatattgcattaaatcaggtaccaacgtgggtcccggtgcagaaagtaaggggtatttcggttatctgttcaagttggattatcatgtgaatccgccgggcgagtttagacgagaggtagtgcaggaatcaagcgctcgtacccgagtgtgggtacctgattaaacggttggtcgcctgtatcacccacgtttatttctcaatcagtccatttcgcccacgttcagtgactaattcgcatagttgaccgaggaatgaggacttttattttcagggtgaagatgggaaaaagtaagtaagcccctgtttagacaatccatggactactgctgtccgagtcgaggcacctagcctaaaggcgtgcttgtgggccctgaggacgtccatcattcaatttcacgcttagtttaactgtgtcagtgtcctgggaggactatcactttactggtgagaagacggtgtgttggagaaagacagcgctctgcatcaccgtggtgatctacggaacctctttccccaacgagcttcccctatcttgcggtcgttgcttttgttacaaaactgtccccgaggcggactgagtaaactgggaagccaccatgtgaccaggttggttgcggtctgtatcggtgatctgtgactggaggtgtggtacggaatcatcaaagattcgtgtttcttgctcttgcaaacgtcctgagcggctaccgtcctcccccagcacatgtcagattaggtcttggacctataaaagccacttatgagacctactccaaacatttcgtggaaatacgaatcgtatgtgcacaaccaccgtaaaccacagggctgggtggcaagaggtagtgggcggcgagcgagcagcaaagtttcaggaacagtttgcgctaatgtctgtctagctctgtggaagaggccgccgtcaggtcaaggtttctggtcgagtctaagggcaaaagagattgagcactttgttggtcaagccgcgtactgtaggtcgtcggtgccgtttgttgtagcggtgccgtgtgagtagggacagggccaaggtgccgttcgaaggcggtagtgtggcttgccaggtagtaatcgcatctctcgggctctctgatgaagttgtctcgtcagtctcgcccgtccgataacgaatacatgagggacgcggacaaagtgggtttcgggaagacgacagtggttagtgcagcaactatacccaggttatctgatgaataggtcaaaaaagtaacgactggcatgccggcgaggcgacgacaccggacatatttgctcgtttggtgcagctttctgtgggctggtgggtgactcttggccgccctagagcccaggtctctgttgcctccactctttgatggtgatccaggtggagaccgttaaccgttgcccgtgtgagacatggttgtatgggtgggttggccaagtgaaaccgtgggggttgcagcgagcttgagggtgcactagtgggaggctgtttgccaatgttgcaatgtggctgtcgtcggacacgacatttccacttttagttagatattgctactcgggccggtgcggatacgtttctactcaggacatcccgtagtgtgcagtgcagtctgggagacatgcagaaacgattggagaaacccgaggacttggtgatcaagcaatcaagaatgtgcagcggaacgagatgtgaactccaactcaactcaactccaactctctccaactccaactcatctcgacctccaactcgagagacgaacacaacctccgcgaagccacaccgctgttgctgtcgacacgggcaaagttcaatctcagctttactccacccagcaggagcgggaatcttgcagtgtagaaatacgagacaagtggtgtgattgtggtcgacgagaggtgcccacttgaaacatggcacacagttggttcaagacacagtcgcccatgtctttgtcggtggagtaaactggttagtctatccaccttgcctgacagtggcgctcctggtatacactggtccacggtggacaacgttgtatatatctttgacggcagtgaggctatatcattggctcaattgaggtctgtactgttttcagagtggtcttcaagtacttctgctcgtgctcgtgctcaatcctgatcctcccggccttctcacaattgtacaatacctgtattcaacacatgtcttgggcgctagcggccgtcaaacgtcactcttaatcgacgctaacgcaatctgacatctgacgtgcggagatccgtcgtcatcgtttatcgaatcgagctcgcagtgaattggtttttcacaagtccatgcaagttcaaggccaatccgcagcacttgtacaggtgttgtacttgtacattctgaacaagtagcgctggttaacatgctcggcagactgttgaggaccctattttggttgttgataccgtacttgtacttgtagtacatgactgaccacgttttcgaagccgcaagattgtgagttcgattcgtgttgatgatgaagcaagacaccattccaactgcgctagcacattgacatcaagagcaaccaagggtgtgtactggctcttgttcttggtactgtatgtacagagcactaccaagcaaccacctaaaccaccaccacttaactcctcaaccacttgacacatcaaccacctacttaccacctacttaacacaccaaccacctacttaacacaccaaccacctcccacaagctcccacaagctcccacaacctccacaagctcccacaagctcccacaagcattactaataaagacaccctcggctcgatcggaaccttgtctagcttccgatacaacacaaggaattagactggcttttataatgcgcgaattgcactaatagacagtgcgtgacaacactagcccggagagggatagctatgcgctgtccttttagcgccccaaaggagttatagccgtgtgcacactagagccatctcctcgacgaacctgcctacggtagagtacttgcagactcacattccacaagacccagtcgcacaaggaagaatgtgcaccgtggtcccagaagcctgcatggaaaaaaagtgtgtttggatttagatccgagaaatgacagcgaccacaaccgtgagcaggaggagaaccaaacgagcaattggggaccacaaggagagcgggaaacaggcccagctcgttcgccgccacgcctgctccatttcaagagcttcagcaaaactctagctgcactccacgcttggcttcggtaccttcagcattgtccggtgcatattcagggcttaaagtgtaatttccatcgagcaatagtggatgttttgcagatggttgtacactggtttgcacgcggacacttgaaagaaacccgacccaagacgattactaatcattcgactgcaatcggggcctgttttgtagactcccgaggccgttggaggcatgtatagtgcctgttgtatagattccctcagtcgctcccccggagttaaaagcaggaccttggcgcggtttagttaggagccaaaacaatacaagcttgtgctgtttaccgttttttacacggcaaaagagacgaggctgtgcggtggccgcaagacctagtgcccctggaggggttggtcagccaaaaaatgccgttttcgagttgctgtagacgacggaccccggaggtctttgttgttgcgccgttgtaaacaccgcaattctaaattataattcggcagggcgaagaagcgtatttcggaaaaaaggctcaccaccacttctctcactcctgtgtcgaggactgcgtctgtctcggttgcattaccttcgccgcgaccatttccgcgaacaccacaactttcggccgctgtacccacaactcctcacaccacacactcgcccagcactctcttgtggtatccttgcataatctgacacttgttagacatgagggccagtaccgacggtgagtaccagagacgggaccctgaagggctcaacatggatacagtcagggacatggcagggacatggcagggacatggcagggacacagacagggacatgacagggacatagatggggacacagactccatactaccgacgctacgatatcacggagatacagacatgacaacccccttatgacagctcctattgtacctgatggacgacacattccaaagaggcccagagagacattcagcgaagaacgccacagtgtgtcgtgatattccatgtctagttcctctagatgatacctgtgtgtgtgcttgtgccatgagagcatggcaatagctggcctttgtcagttgtgtgatggatatgatgttactaccataagcagccgtttccgtgtttactatccagacatgcaactatgcgagtgttgctgtgactgtattgtcatttccaaacacaaccagggcagctcttgatatcattatctgcctttggtgacctttactaacccagctgagctcgccgagcaaggtgacaatatagcccctctacaagaggtaggctccaacattgacacgacacaatccaagcgacacagattcggcacgcaacgccgcacccactcggtcaaccgacgacgatcgctatttcaaaaactcgtgcatcctgaacgagtcgaggtcgacaacacccatgagatcaccgacgaggctcatggcccctcgcgaacagtctacttcaatgagcctcttcccgaggaccaaaaagaccccaaaacaggcaaccccctcgcacactatgtgcgaaacaagatccgaaccaccaaatacacgcccatcacttttgtgccaaaaaacctgtggtaccagttccacaacgtggctaatatttatttcctgctgattgccattctgtcagccttctccattttcggagtgcaatccgccggtctggctgccgtgcccatcattgtcattgtcgtgctgacagccatcaaggacgccatcgaggattaccgacggcagattcttgacatggaggtcaacaacaacgtgacccgtgtgctggacggcatcgagaaccccaacgtcgaggaggacgacgtgggtctgtggcgacggttcaagaaggccaactcgcgcttctggggccccaagggacgggcctttgtgcgactcttcatgcccaagcagcgacgaatcgagtccaaggaaaaggagcaggagctgcacagggtgctctccaataccacggtcatcaccgcgcgaatgagcagtgatctcggtggcagaccctcgggtgtgtctcgtggacgtcgttctgacgtgcgacgatcggacattggacgagacgtgcggccctccatggacctgggccgaccttccatggaccgcgaccagcgacggtcttctgtgcggttctcgggcgactttggcgagggccccgcgggcgactctcgtactctgcgagccagcactgacaacagagacagtaagaaccctggtgagttctcagacgaccccacagtcatcgactacaaccagcgaccggagggcgtggccaagttccggaagaagtactggaagcaggtcaacgtgggcgacattgttcgagtcttgtccgacgacgaggtccctgccgatattgttgtcttgtccacttcggacgacgacggagcctgttatatcgagactcgtaacctggatggtgagaccaacttgaaggtgcgacaagccctttcagccacaaaaggcatccgtcacgcttccgactttgagcgctcgcatttcgaagtcatgtctgaacccccccacgccaacatgtactcctacaatggtgttctcaagtggagaaacacagacggaggagcccagagcgagcctatcaactccaacaacctgttgctgcgaggctgctctgtgcgaaacacacgatgggtcatgggtctggttgtgttcaccggtgacgacaccaagattgttctcaacaccggagagacccctgccaagcgatcccgaatgacccgagagctcaacatcaacgtgtggtcgaacgtggttcttctcgctgttctgtctattgttgccgctgccgtccaatcacagcatttccgccgtcatgacacttctgaccacttcttcgagtttggaattgtcggtggaacctacgctgtaggtggtctggtcacgttcttcaccttcctcattgttctgcagtccctggtgcccatttctctgtatatttcgattgaaattgtcaagacgtgtcatgccttcttcatctacaacgatatcgacatgtactatgctcctctggactacccctgcacccccaagagttggagtatttccgatgatcttggccagatcgagtacatcttctccgacaagaccggaacactcactcagaatgtcatggagttcaaacagtgtactattggtggcaagtcatatggtaaggtgtttaccgaggccatgctgggtctccgaaagcgccagggagccaacatcgatactctcaaggttgaaatggagcaggatattgctgacgaccgacagctgatggcccgggagatggcaaaggtgtaccacaacccatacctaacagccgagcccactttcgtctcttccgatatcattcgagatttggagggtgcctctggccctgatcagcagaagcatgtccattacttccttctggctctcgctctgtgtcactctgttcttccagaggttgacgaagaaggtgtgcttgtgttcaaggcccagtctcccgacgaagctgctctggtttccaccgctcgagatctcggtttcactgttgtggaacgaactcgaaaatccgtggttgttgacgtcatgggcaagcgaatcgagtacgatattttggccatgttggagttcaactctacccgaaagcgaatgtccaccgttgtacgtcttcccgacactggcaagattgttctgctctgtaagggagccgactccgtcattctgagccgtctcaaccgtcagattaacgagtcttctctggtggaggaaactgcacgggatctcgaccggtacgccaacgagggtcttcgaaccctgtgcctggcccaccgagagatctccgagcgggaatacgagcagtggtacagtctccattctgaagctgcccgagccattgagaaccgagaagacaagatggatgaggtggccgagcagattgagcgagatctgcgactgttgggaggtaccgccattgaagatcgtcttcaggagggagttcccaactccattgctcttctggctatggctggaatcaagctgtgggttctgactggtgacaaggttgaaactgctgtcaacattggttactcttgtaacctgctggataacagcatggagctgatcaccatccaggtcaagaaccccacagtcgagtctgtcggagctgttttggacgagtttgctgccaagtacaacattgatacgtccaaggaggctctcaaggctgccaagaaggatcattcccctcccaagaacaacgctgctgttgtcattgacggtgacgctcttacggtggctctttccgatcctcttcgtatcaagtttctgctgctgtgcaagaactgcaagtctgttctctgctgccgagtgtctcccgcccaaaaggcgtctgttgtttctctggtcaaaaagtcgctcgatgtcatgactctggctatcggagatggtgccaacgatgtctctatgatccaggaggccgacgttggtgtgggtattgctggtgtcgagggtcgacaggccgtcatgtcgtctgactacggtatcggacaattccggttcctcaacaagttgctgctagtgcacggtcgatggggctaccgccgaattgctgagctcactgccaacctcttctacaagaatatcgtctttgccatgaccattttctggttccaggtgcacacggccatggatggtgtcatgctgtttgattacacgtacattaccctgtttaacctggcgtttacctctcttcccgtcatcctgcttggtatttttgaccaggacgtgagttggcagatctccattgccgtcccccagctgtaccgacgaggtatcttgcgtctggaatggactcagtggaagttctggggctacatgctcgacggtctgttccagtcggtcatctgctacttcttcacctacctgaccttctacaagggccacgtgaccaccaatgttggccgagagatcaactaccgagaagcctacggtgcctacgccggtacagcgtccatgattgcctgtaacatttacgtgcagctcaatatgtaccagtggtccaagccgttcctgatcatctgctgggtgtcttctgcgctcgtgtttgcgtggaccggtatctacacgcagttcacggcgtcgcagctcttctacaagactgcgcagcatctgtacggcgccctcaacttttggacctgcctgttgctcatgatcattgtgtgcattctgccccgacttcttggaaagtgtgtgcatcgatcgtggttccccatggatattgacattgttcgagaaatgtggtgggctggtgagttcaactacctcgagggccaggacattgataccattgtgtctgagaccactcagaactacggcacttctgctcgagagaagcctggctacgaccaacctcccactgacgagtacagcgatcccaacacggaccgagtgtacaagtctgagcgaaactcgttcatggagtctgccaccttccctggtagtgactaccccgtcaagggttactcgacgagccccgtggagatggacaatttggagaaacggccgcagactgacgattcgcacttgtcaccctttgcggaccccaatcccaacaccagctcgcccatgcagccggctggacgagacgttttgcattctgatgacgacgagcatttggttcccaagtagttggctgtgcggcagctgtcaggaggattatggagcacaagagatagagagagaaagttgcaggggaggcctgcctttttgattcagtaatattatttttgtacgcatttttaaaccaatgcttgtagtgatgatactcttactcagctcattcatactcgtacaatctatttttatctcactcattcaaatcacgtgagatatcttgtgagctatttggacgaaattaactcttgcttccactcttgccgtcgctcgattgccattgttgcgtcgtatttcccacacgtcgctttttttgcttgctttctccatcttttcatttgccaccatcgttcctgtcggctcctgttggtgtgcacttccatgcgtctagaatggaatgttgacaagatggatgatgcgtagaaaatgacgtaagaaaaacaagaacgattcgtcgtcatctgatccgaaggacacgtgtcctcggaaacggcgtatgctatatttatatcgatgttcccccctcacgccagaagcctctaccggtctaaatgtcgccactactcgaaatcgaattcccaaccagcgcatattagcgcttgccaagtcaactgaaaaaaatatatccaaattcaaaaagggaaaaaaaagggaaaaaaaaggaaaaaaaaaggaaaaaaaaaaaaaaaaaaaggaaaacgcaaaatgacatgacctaaactctacgccaccaacaatagaccccttgccgttgatagggaacacgcccagataacttgccgagcaagacggccgggccgtggacgctgttcacgtgatcagcaggtgtatatcgggatatgatatcacgtgatcatgccttttccccacttttgccacctgcagcaaaaaaccagcctctgcacccaacagtggccgatacggctggttcgtgccctagccctattacccgttatggtttggtgcatgcagttcctgtgattgtctgcggttgcaaaacaccacagcctcgccatctcaactttggcacgacttgcacagccaagagtcttcctgacgagatacacgttgccctcattcgacacgagcattcgaacagcgacagaaaaacgcaccatcgcatttttattcacctcacagatacaagtacacaccgtctgtctgcacacacacccacacccacacaatgccatctctacctcttgaacgacggcaatactacagcgacggctgctacggctggggatgtggcggaaactccggctggaacaactggggccgatggattctgctggcgctgatcatcggagttttcctcatttcgtttctgctagtgtgcaccaccaacaagagacggctcaacaggggccaacaacccatcacaggaacgtcgtggatcgttcccccgacataccaccagtcggagcagcagtaccagtctcaggctgctcccccatacaaccccaacgccaacagcgaccccacagccgcaggatactatgaccaatccggcaactttgtcaacacgtcgcaccatggcgccggctacagcaatcaccagggaggctacacatccaacgatgcctatggtcctcctccgggcgacgcttatggtcctcctccgggacctcctcctggacactcaaacattgagatggaccagtaccagcctccgtctcatcctccgcctgcgtttgtcaaaaattagacccttcttccctctcaaactaagagtgtggtttggtactgtcagtaattccgctcattccggtaagacactggaaatatttagattcaatatttattatgacccgctagagattgttagtttgaactatcgtcttgcacttgtagtagtagggctgctctcgtatgtgcgatagcggcaactctggaaagccgcagacgacacaactgtctccattattcaaactgagacatgaacggagaacctcgcagctggtccccgtcttttacactggtccaataccacctagctcaacagtatcaaggttggacagggccaaggtacaaggcacagtatacacatggtggggtaagtgggtctcggacctcatctcaacatgttaggtggggtctatcaagctacagctaacgatatatatttacagtacacttgtacacttgtttttagcgatatgccaccaaccgacaagttgcaactcgatgatcaacttctcagtggaaacaggacaatcgaacgtggtctgtgtgaccagcagctccggtacaaccacctacagccttcccagcgacttccagctgctcattcacattctgcacaaagatggatctgctccagacgagtaccacctgtacaaaaagggcaatccgtcgcagccacaacatcatggagagcatactgttcacaccgagtcggtcgccatgcgattgagatattcacaatgagactgaaacagtttgtcacttgatttctaatcacgtatatatctctctggggtctcagccggcccaacgcagcctattgtgcaaatccaggagatctctacaggtattgtcagatgagcgcatggtcgacggatcagccgatatagcccctcacatgttcttttagaacatcactgctcacgagctccaatggctccatcttgcatccagatcagctttgctgctacagccttgctgcagcacactcactcatgtattcaataaatatccatactgcttccttcatactttgtcagttccctccttgacagcatagaacaggtctccattcttgcccagcatcgacttgatcttttcctcaacaacaacacccatacccagcagagcagactcgtccatgcgacccatgagcagcgggtagtttctgtgagcgtatccggaaacgtatctatgcagctgctccaaaagttggttttgagggagtgcgtcggcaggtccaggctcgggaaaaggaggagtctcataaacacgcgccatagatccgtcttcctcaaagtaccgaggtgacttttcctgaagatcggcaaagaagtcatcagcagcgtaagggacccacttgcttgggggatcgtcgtaggaatactggccgttgacacacgagtatacgtttggtgtgaaaggacccggtttctcggcctggcgtttcagagtaagccaatcggccatatcctcgtccattcgcttttcgtgcaaacggttgatgaagaagttggtgttgttgtaagaccgactaacaatttcacctgccttgtcgataacccgtcgaggagacgcaaccacctgcctgaggttctgattggttaatagctgtgtagccctctccaagacagtaggagtgagagtgacataccctcctggttgcttaatgtttggagtaatgtacctgcgcacagatttatagatctctgcctcttcatcggggtcaaaaggtggtggtcttctggcccggttcctgtgctgctccagattatgcagcttttcgtggttaagcgtaccaggtcgacctctgaacaacggcttttcatatgtttgcacaatgttttgagctagccgtttccttgcccaggcttctctcttggcaattttggccttctcctgtttcacccgcatatcctcaagcttcttgaatttgatttcctccgcctgttcctccttgtacaacttttcttgcatgcgcttctgaagccggagaagctgttgctgctgtttcttctttctggcttccgccctggtcctgctcacgtccacacgcttctggagcttttcttcctcacggattctcgccaacctgccgtgctcagccttcctccgcttgtcggcttcgacttttgcctcaaactttttcttggaggcctccagttgctgtttccgttccaaaagtttggcctgtctacgcccctcaacagccaacctctccatcatccccaacgaaagtccaggaagacatccgtctgtctcgttggttgtgcgggctgtgtcgctatcattgttgccgtcgctgtcattgtggcttaagatctcgactggttgctgtccaccagagtcacgctgtcggacagactgtggcggttcttgcgagctggacgtctggccttggcctccttcttgcgggccttctcttgcttgttgagtcgtcggagctcgcgtacatcctgggccatcagccctaccatggaagctagtagagcgatcatttcttcttgtcatatggtggaaaagagaggcgagcgacgctgactatataaatataaatgagaacaactttgatcgcaatcgaacatgaattgggttagggtttaaaacgccccgcgattaggccaaaaaggtggtcatttatgtctgtatggtgagtgaggagccacttgttgaatcggtcgtgttggaattttccagaggagagttagaaaatcagtttagattgacttgatggtctttgtgtatctttctttgccggatccaagccgatctagaacggaatcaaggcaccatcttgtcttaccgttgcgtatacgatctgagacgggaagaagtgtaccttggtgaaccggtacgagtgcgaggagtccagaggtggattgtgacatgtaattttggttgattggcgaaagaattactgtcgggagtgcaccagttcgtattgtggctagcttaccaagtacaccatactggatcaaagttggtgtgtttgaacaagttcttgtagctaccggaactaccgtaaaacacaataaatactttaccatctataaatatatcaatctcttcagttggctctctccaccgagtagttgatcataacgcctaggccgcgtttctcaagtttctgggcggtcagaagaacctcgtggtggttggttcctccacagtagagacggtagacgaccattttgacaaccgaattgggcacgtagggcaatatctttgcgcacagttggaccatggacggccggcaggtcatgagagaagccagtcccagcgccatgacgtctcctgtagacatgtttgcgagaaacctgggctgggagttgggcggaagcagtcgtggagttgacgaaaaggatgtggaggcgtcgtaggccatggaggacgagcctccagacacctgggacgtgttgaccatggaggttctgacggtggaaggtcgaatgaatcggcacagtcgcagggtggggttcatggtgtacgagtacaatactgcagacagaaaagtcatgaccaggttatgcactatatatacactccggggacatcgctacttccttctcacacgcgctcaactgctgtaacctaggtgtgtatggacagtctacatccagacagtttggtcgaaacagcatgtgggagagagtttccgtatacgaatattgtcgacagtacatggcacatgaacggagtatgaatggggttacgactggaaacggaaggagatggccggagcgtggattagccgcaaaagttgagaggtcacgtgaggtggtcatctgaccgcaatggcatgtttcccccccgtcttttcgttcttccttccctctttttgctgaggtgtgtctcccaccatgttggtccatggttcacgtctgattaataaactccttaatgagaaagtggaaaaacgcgaaactctgttaagacgccaaacttgtccccacgactgtcgcaaatcctccatcagcacgaaatggccaaacgagacctgcctaacggctcgcagacggtcgccaagcgtcgacgcacgcaggacgaacagatgggcgtgttcgacgacgacattgacgaagaacaacgggcgtacaacaacgagattcgagaacacgaccaacaacatgggtccgagatgatcccccgacccagtctcgacatctgcgaaaagacgggctaccgaccgggcagcattctccagatttacatgaaaaacgtcatgtcctacgacgagtgtctcgtcaactttggacccactctcaactttgtgattggccctaatggatctggaaagagtaccatgctcgcagccatctgtctggcgttcgcagcccccatcacatgcatgggcaaggcggcccttaaggcccagcagctcattaaatcgaccaaggacgcgctggaggtgcgggtcgtggtcaagaactttgcaggcatgccggacctcacgttcaaacgaacgctgacacgtgacgagaagcagggcaagttcttcattaacggcaagtcggctacaatgaaagaggtgcgtgctaccgctcgagagctcgacatccagattgtgtccatgacccgtttcctgccccaggatcgagtcaaggacttcaccaccatgagtcccaaagagcttctcataaccaccatggaggatgtcggctacaaaaacatgcgtagccactacgactcgctggtaaaccagcaggaacacagtgccgacgacgagcacagactgcagctggccacagatgcacttgcggatctggaccgacgaagaaacgatctgactgacaaaatcgcccaactggaggagcgtgagaagcaggaggagatggttaagaagctggaaaaggtggctgtttacagcaaaggcatttttctgaaacaggagactgagcgtataaagctcgaggtggcacagttgaatgccgccaacaaagatctgattgaggagaaagagactctgagcgagaagatgggctcgtaccaacaagtcattaagacatgcggaaatgaaatgtctcaaaaggaggaaaaggccaaacagtactggcgcaagtaccgagagctccgtaataaggataaggagattgcgggcaagatggccaagcacgagggagactttgaggctgcgcagcgacgtctcgacaagcacgaagaggaaaccaaggttctgcagaacaaagtccaggaggatcaggcgtcatacactgcattgtgcaaggagttggacgaccccgcctttcaggagaggaaggagggtctcaaggccaagctggctgagttggacaaggactacagcgaggctaaacaggtgatgcgagacttggaagccaaaagacggaacgaatccggcaaggctgatgagattcactctgcattggagtccgagaggcgtgtgaacgaccggtttgtgcctgtgcagcgaatcaacatgaacctgatccaaaaggtcaaacgaatcgcacctccggaccagttcagatactcgctccctgccatcaacactgttcgtcttaaacaaaacaacctcgatgaccagagaatggtgagcgccgtggtcaggaccactgcccagcactttgtggctcgtgattccagtgctgctgcccagattgtccgtgttgaagataaaattactgttcgagaagtatccaagtcgtttgaggaggcgtctcatactgtgcctgtcgcccgggagcagcttcgagggttcggtttcgacggatacattttggaccttgttgaaggtcctgatcataacctggcccatctttgcgagacagccaaaatccacgctgttccttacagtcgacaaggacttactaccgaacaaatctcaaagttgcctccgtccatcaacagattcatctccaagaacatgctgtacaccgtcaagcagtctcgttacggacagcggtacacctctacaaagtccgagccgatcgacacctatcctcccaaaaaggattctcaaatcatctacgaaaagttacctgatcggtcccgagagcaggaactacaggagcagtatgacgaacttgtgcagcgactcagacccttgaaggaggaagtcaagactgcaaacagtttgctacaggacaaggctcacttaaaaaacgagactgcagacgagctgcgtcgatacaggaccagggagagtaagaaggatattctggccaagaacctgcatactgcaaaggtcaagctcaagaagcacgtcgaaaacgctccagcgggcattgaggaggtcaaggctcttatcgcaaaaaaacgaaacgagacccgcgacgagattgctgccaatatgcttgatcgagtcaaggtgatcaaaaagctgggccagatcattcctgacgctcagaaggacgccattgcgcttgccagagcaaatgtactggtttctagtctcaaaacccgatacgccgaggtggaggccgagcgtgcccagttcaaagaaaagttccagcgtctcaaggagcgatacaaagctgccaaggcagaatatgaagcgtacatggcgaacaaggaggaggtggagcccgagtacgtggtgtttttcgaagagctcaaggcacaatacgatggccccgatctccaggcacatgtggatgcacagattgatgctcttcgccaggagctgacgtttgccaatgtcgatatggatgctcgaaacaagtacgaagaggtgcttcgacaggccgagcgcaccaagcaggaggtggtctatctcaccaacaaacgagacaatgcggccgaggagatgcagaagatcatcgacgtgtttgtgcccgagcttgagagaatcgtcaatcttgtttcttcgcggtttgccgagcttctcaaaaagaaagaaaaggcttctggtttggttgttttgagaacagtcaaggagaaggccaatcccaacgatcctagtcccgaggagcctctcccgttttcccaatggggtattgagatcatggtcagtttccgagagggaggcaacaagtgtaagctggatggaactacccagtctggaggagagcggtccatttcgatcggaacttatcttttggcgctacagggggttgctcctgtggctttccgagctctggatgagatcaaccaggcgctggatgccaagaacgaagtgattatgaaccagcatgttgccgacacggctgcggactttgaccagcagctatttttgctgtcgcccaagctcattcacttcaattaccccaagaagatgcgaattctgaccatttgcaacggttcgggagttgcaaccaagggagcgtctggaggttccttcttggctctcaagcatctccagcaggtgttttccgaatagacgtaagtatagaggggaaagtatagaagagtaatgaatatttattgttaacatcaaagattgagtcgacatggtaacagatcaatgaaggatatactgtagcggatagcagaagcctacaagtggttgcatagcgtagagagcccttcaatagtctgttcggatatggatcatgaatacattatataaaaatatggtacagatcgtataaatacatgtcgagagtgttagcttttgggtggtgtttgtgagggatcctgttgctcaggtactctttcgtctggttttgaggggagaaatgtggagtagtttgacatgccgtttgagagagtcttctcgtacaaacccgcggtcacagattttgcatgtgaagggtgtttgtcgatggaccgagtttgtgtgtcttcgcatttccgatcgagtagagaagcccacaatggaccagggacattttgtgtcggcgcatttgcagcttcggtcatgagaatgcgagtcgaggtgggtggcaaagtcgaccatggttttgaacttgacgggggtgccctgcttagtgcagtggctacacacgtaggctcctttcttgacggtgtttgccatggcccaaatgttggggttttctttgagctggtcgaccagagagggaatggtgcagtattcgtcgaaaaagtaggggctttcttctccggaagaagaagacacgtccgagggctccgagggttcttccgggagcacgttatcgacgatgggtgcgtattcaaccggcgggaatgtcagcgagctccagtccaggtaaggaggcgtgatgggcatgtatcccagacagtcgtcttgtttggggtattcagtctgtggcggatatgccgtgtcaaagttgaagtcgaatgaatacatgttgagtgatggatgtggtggggtgttgtgtctatggctacctcctccgttatatatatatatatatatatatatacatgtcaaggccagaagagaatttcatattggaccgtgcctcatcggctactccagatatgagccaagattggagtttagcttaactttttaggcagggatcggcgggtctccacttcggatcccggaaacgccaaattttaaatggacgccccatgtaatccgaaaaggagtcacgatcgagtcatgggccgcgtggaatggcggagaagcacgtttgtggtgtctccagaacggcctggtctcagagccagtctattgatccaaaaatgcgttcgtttggcccacttctcgcctaagcatgttgtagcacggtctacagacctgcagctttgactcactttgctctcaagattattaaatgcacctgtcccgtaggggatgcgagcattctcaaggtcgtattggtgggattagcggatttggagggcgcaagagtcagctttcaagaggtagctgaatgtagccgtacgagtagccacttgtagccattggccgtttggtggcagaaagacagagtataggttggattacaatactttggcatacaacagactaaacaccagccaaaatgacatgttcacaatatcgatacatgtcaacaatactcgtaccgtacagtcggataccgactcatgtaccccgctcctacagcatgaatatacacactagagcccattgttcattatcgcgtcccttgtccattgtcaaacacagtggtgacgcacggtccttgggatgagatgccgaaagtctgttgaccagaagttgctttttttcacactaagtatacgagtggatacgttgctgagacatccggggggggatcatcggggccttgtcggagagtccaagatgacatggggattgtggattcaatcgtggatggtgaagtactcgccttgtagcactctctggagacattgcatcacgccactgatactgataacgcaggctcatgtgtgggagtcggtcgaacaagcactcgccaaccacagcactttgagaattgggcagcgttttttatttttatttttatttttatttttatgttttttgttttttattttttatttttgttcttgtctcgggtgcagccctttggttcagtccaggatccgcaacccagtggctgaggcaaaggttgtaatgtggcacccgatcgcgtattgaaggtgagcagtgtgtttctttgcggagcttcgtattggtagctacagttcttgtacgcttggagtgtcggatacgttcactttactgtatgtgcaaattgggttgattcaggctgatcgcaggcgcactgtattttgagtttgccattgtgttgactgtcagttggagcaatgacataataataatagatggagatattaattcataatacaggagctatgaacggctgaaatatgaatatgcagaaaacgccgatgggcgagccggctaatccaccggcggttgcaaaccagccgaaaaaataaatatacacgggatcccacctcgtctcgagactgctctcgactctcccccgtgttgctcttccaagttggggggtgctagccgagctcctgtacggctaatattcccttttgaatgccgaagtcggttaaagttgcccgacgaaaacgacggtaaaaaacctccgtgaatgcacgagtgtactcgctccaaaacagacaggctgtctatgtaagggtccagaaggggaatgggaaaatatacatgagacactacaacacctaggaagccagcagatagttatattgcgctgctacatcgcctatccgcctccaatgaccccaccaacggcatttggacgagtttcattcagacccaaacaatgccaagcataataaatcgtaaaaaaaaaaaaaaaaaaaccaaaaaaaaacagggcggatatcatgggaaaaatctggagcaaatgcagctggtcgcatggccagtagggacatgttgagcgagcagactcgtcccatgacctgatggtggaatgttctcggcgagttgcaccagcatgttgagtcagagtcatttatctgtagtatgttcatacttgtaggtgtttcttgagatctgagagctacaacatttaaaacttgccactttttttttattattattagtattagtattattattattatttttattttttaaacattttactgtagggaaatatatttcaactacttgtacttgtctattacgcatcataaaatccagctactttgatattaaccattatttgccgatttttgacattttttattccaatgattcacgattcattacgtacagccgggttattggcgtcaataaatcaaacgcataatcgttgtgatgcgcgtttcggtgtcaatgagtttgagactgccaatatcgtcgcttcatcttgtttttgtcgcggtcacgtggtagtgaatcacgactagcaaatcaatcatcatatcatatcatatcatctccaagctcgaagttggattagttgttttcgtgagggtcgtaaatggtgttgttatcatgagtcgtgtatcatgattgagtcgttgcggtctcaggggttgtcgtacgatgtcattttttattctagcgaaataaatacatattcttttcaattttttattcaattttgtattttattttatttttctaattcgttcttttttttttattctaatgattcactacataactttttttttttttattctaatgattcattactctgactaatcaaaaatatgcttaatacaagccacgttttcaaaatgaaaaaaacgtccgcaatagtttagtggctagaatttccgcctgtcagaacattgttcagcacgcgggggaccggagttcaattctccgttgcggagttctttttccaacacaaaagttgaagttttttttgctctgacaatgctggtcggaaaccacgcctcattttcggtcggagaagccgttttcctccctattcgctccatttccgaccactttcagggtctcatctcgagtgcattatctgtttgtctggctcttgcataacctgtgctggcccttgtgtttagctgcagaaacgtggacattaaattaatagcgcgaatttcagccggtgcaggcggttggtcgatggaggagtatatggaagtgaacagagaggattacgtaagaaaagaatcagcaaaagaatcgctctagcccagccaaccgttggcttttccgcgcagcaacgttcaccagccaccaaaattgtttgactcgatccactgagcctattgtagtcacatggtgtcatggttggaaaaacaaacttgagctcttgaccaactccaaaacacctccgaatggcccccagaatcgcaattgtctactacaccatgtacggccacatccggcagcttgccgtggccatcaaggaggggattgaacaggctggaggcactgcagacctgtttctggtgccagagaccctatcagaagaaatgctggccaagatgggagctcctccaaagcccaacgacccgctggtgacaaacgcgattctcaccgagtacgacgcgtttctgtttggaatccccacacggttcggcaacttcccagcccaatggaaggccctgtgggacagaacaggaggcctgtgggccaatggatctctgtacggcaagtttgcaggcattttcgtgtcgacaggtacccctggaggcggccaggaaaccacagcagccgacgctctgtccactctggttcatcacggcatgttgtacgtgcctctgggctacaaaccggcctttgccgaactcaccagtctcgaagaagtgcacggaggctctccatggggatctggaacgttcacgggaggagatggaagtcgaaacccttcgaaattggagctcgacattgcccgtattcagggccgggccttttatgacattgttactagaaaatagatattgaccatgtgctgtgcaatgtacgactccgacctatgcttcattgtttacattacttgacctccaacacttaaatattccaattaatgtacatatagccatgtcatacattagtacaactgagaatgcttcacaaccgtggcaagccgacattctctctattaccgccactcttccttcaccgggaccgtctcctcttaaaaccggaagccgtgctgaaagtgctggcctcctcctccacctccacgaccttgcccctgtcgagcctgctgcttcatctgttcctggaacatggcagcgaaatcaaaacctcctccaccttgttggaactggaagcctccacccccgcctccaaaggggttctggggctgatgctggccctgaccatcaaactcacctccgttatcaaacgcagccttcttttgagggtcagacagaatctcgtatgcttcgttaatttcagccatctttcgctccacagcagtatcgtccagatcgcccttgtacttgtcaggatggtacagcttggattgtgttcggtatcccttcttgatgtccttttcggtagcgtctcgtgcaatacccagaatcttgtagtagtccttggactttgactgcttgagaagcacagccacctcctgctgccggtttcgaagcagctgcaccttgtggctgtcacctagggactgccagtactgaacctgctcggataggatcgcatcagcctgctcaaactgctcctcgtcaaccagcttgttggccttaagcatgactgcaggaacaaaatgctcgtctcgtcgagaaacaagatcgcagaaaacagcccgcgatgcagggggcttgttggctttcttctgggtctgcttggagtacgcctcacaaagcacctcctccatgctacccacgagattggaaacagagccgagattattaattcgatcaataggagcaatggttagagcatccatgaacaccctggtgtctcgcacaatgtcgtcaaacagaccctcttcaacccactccttaaacagtcgctcatagagaggatcagcaggctttctgtctcttttactgtccaaaagagccaggccgggcttcagcaccttgtctcgctttcgaatttccttggccagccgtccacacgttttgttttcgggatcctgacgcagacacttttgtcgaatctgctgtagcgccttgtcgggctcgtacagcatgtaaaagtagatctgggccatctcctgggccagctgcacgtctgcagggtttgccacttgcaagtaagacaggtcgaccagtgcagactgggcctggcccagagccaagtgacagttggccttgtatttgtgtaatgtgattgactttttagccaccttgagggcctcggttgcgtgaagaatacacgactcggcgtgcatcttgtcaatgggctgctccttgtcctgggactccaggatcgactggtaggccttggctgcggcttcggtgttcaccaagccactgttggcaccctccatgatccgttttcggtctctctcgtccatgcccttgagatctgtaaggggctcgaggcgctggatcgacttgagaaactcgccctgtcgcaacaacgcctctgcaatcttgatggaggccttgtgcatcttggggttgagggccagggctgcttcaaagtcgtccagagccagctgttgcttgtctttgagcagcagcaccgttcctcgtcggtacatgactcgcgagagctccacggggtcctccacggcgtcgtcgccctgcgacttttgtcgttctagcgccttgtcgtaagaatccagcgcctggtcaaaggctcgttcggacagatacttgtctgcctgggcaatgaggtcgcccatgagcggctcctgcgccatcgccagcggtagtagcgctaccagcggatagatcagtttcattgtggcgagagatagttgtgtgtacttgtacaagtcacaagctgtgttgcaggttgcacttgaataaagcgtgacgtggaaatctgaactttaagcgccgaaacggttaaagctgaggtgtgtagtgtgacgtggcggcgagcagtttggaggcaataaaacaccgacaaccgccatgtttccggggtagggatcacgtgacagcaaacaccgtgcccacatctgtctatcgccacacagaaacctgctcttgcgccgccccacgctgccttcatatcgccaccgatcagattcgaattttaacctaaagaaaccgtttcatattggggagtgaaaatggcgtatttatgaagggacgggacaaggtgcgtttaaagccattaagtttgggattttagttagcattttagttgggacttgatgaagattatatatataacacagcagcaggaatgtcgtcaaggaaccaactacacgggaacggaatcttcgctattatctcaaataccggacaaaaagcatctaaagacacaaacacccacattgccttctccacgtctacttgtagtggcccactaaaactaccctattgggaaccgttgtgctggttggtactgctcgagggcaggtactgacgctaacacagcgtaaagtttgcgataccgaaaaaacataaagataaaactatcttgaaatttggatgaaaataaaaatataaaatataaaatataaaatataaaatataaaatataaaatataaaataaaaatataaaaaataaaaaaatcctcacgatctgaaccgccgccgttacccaattaatgacaggccaaatattcgaacgggctcaatcagactcagaccgacccaaacaaacacaatacaagcttcgaagaagccagaagcgccactttttcccatttttcccccacttcgacatccctgtaggaccctgctctatctaatgcacggctgatcagccttgcttttggcaccacgatactataatacaggtacatccaactaacatgtacaagtacggcacaagtacggcacaagtacggcacaagtaccagtggttgtacttgcactccagcaaatataattcaattttattagcataaatagtgcttgatttctttgagaagggagccttcttataccatccccccttttctccacctatatacgtgatcactccagattccgccgtggcctatctctgaccccgatcaatggaaatggaccgtcggaactgctcgtaggaagatcgcgatcgcacggacgaggaggaagaccgtcgtcggtttcgacgggcaaaatgggggtccaggtccgagttgccagcatgtcgacccagcacattgagaatgtcggtcagcgacaccactccaatcagcttaccgttgtgagcagcgtggtgagagggaccgtgggtcttggaggccggctgaccagagggggtcgacggctgtggagagggcacatcgggctgcacgacccacagtctgtgggcgttggtggcgaccattttggcgatggttcggccgtatgacgtctgcggggtcacgtggaacacggggaaggagtccttgccgtcctccaggccccgggcattgagaatgactgacaggaagtgcgcgcaggtggctttgagcagatgtgactgcgagctcttggacacaagccgcacgtccaccacactgatgttacccaacaggttgttggaggcgtcgacgacggcgagagaagacacattctgggcgttcatctttcgcagcgccgcaataacgtactcatcgcctccaatggtgagcacattggggttgggctgggcaagacccaggtctgtgaggggcgtctggaagaggggctccagcgtcttgaacaaccggccgttctcccagatgtatcgcacggttcgtcgctgggacagaatgccaatgacagcgtcggaggcggggccctcagtgacggcaaatctgtggacgccagagccgagaatctctacggcagtggccagagtggagtctctaggcacacagatgaagggatccttggctcccaggccagccacaaagttgaccggcacgggctggcccgatcgcgccttcttgacgttttccagtgcctcgggagtggtgtctgcggcgtccacgtagcccatgaccagcagcaggtaggcgttgaggtctgcgtagtcgaaagagtgggagacggacttgtgttcaggggcggttcgcacgggcaacgaggtgaagtggttttcgacgagtttatcgaacgccttttccacgggcgtatctccctccacaaacaccagcttgtcgggctgcaccatgagatccaatcggtcgtcttcccatcggcggtagtgctttgcgttggagtcgtcgtaagccgggaacacaggcgacatggcggcctggttgttggaggctgccgacgacgatcgggaccgggagggcgtcactgccggtggtgccgtcaccagctctgcaatggacgactcgcccacggtgggggaggctggaatggcaaagtcgcggttgttggggcgttccatctgagaagcgtgactgccttttcgtgcgcgggcaaaggtggcttgaatggacgagttggacggcgatagagctgcctggggcgattggggggaagcctgggaaggagcagggaccgccaaagacggggtggtgggggccttttccactgaggcgttttctttgtccattttttcgcttgtctgggtgcagtctcttgagaatgtgtgtccgagactctctgttgttgcacttgttgcaccgtgttgcagttgcgttactgtaagaagtgtatgtggtgcaatgtgccgatgtacaggatgtgagtgagtgagtgcggaaaagcggatgttcaagagcactatatacgatagttgagacttccaaagcgggtcccctaacaaggagacaagagattgctgactattgctggcggccagcgtcgcctatttgtgtccaattgaggccctgggcacctccccaactgcgaatctaaccgactacaggaccgcttcagctcaatcgccacccttgcttttttttccccgtgcagcaccgagccctacctcaggtgaaatctacagttgaaaaatggcgccatgccaagagagcgggtggaaaagtgaacaaaaaccggacaccttctgctaaaaaaagacggatacttaagatcccgacggtccctagcggttccaagaacttgccaagttaccacttaccctacaaaagctccatcaccacgtcgcccgatccccagtcaccaatggcactatcgtatgcgcaccttcgacaaccgttcagggcagcaaactgattaggttccaacccaacagtgttatcaaatgtacgacctcaacgtcatgtgagcattgtaaggaggagtgatggcatagcatgtgatttgttggaggtgttgggttatttgcacggtacactacgagcattccggtgtatcgtactcgctcatgccgatctccgttgtgtctcttccaactacttgtacctcacccattaccccaaaccccattggatgacagcaagacaatggacatgtctgagaggagagaaaacaggacggatttcgggatgatggccggatattaattgctcgacggcagtgtggatgcaccgagccggcattaagcaggccatgtctatgtctatatttccgtgtcttggagctattgttggtggtctatactgtatcctattttttaaacttttttaattttatatatatatttgtattttatattttgattttatattctacaccctatattctatattctatattctatattttatattttatattttatagccttgtctagcagttacagtacagaacttttaaccaactggttgaggttgtccagtagaatgccgagatgaaagtacttcctattgtacccacactatcagctccaactgtttataaaccacatcaacacatgctgcatcaatatcatatgtcctctcctccacgattccgagccccgttgcccgatctgaacgttgtcatcatcaacaccttctctactgtatgcgtatcacttcgcattctcgacacagcccctcaggtcacaagaccagcttgtaacttgctccctgaaaatcaaccttgactgaaaacaactttgagtgattactgtttggctgctgaactttcccttttggtcctgcgagcaaaaagctgggatttcgctccaaaaacgtgtttcgaccgcttttctaagcgccttttcagccccttattaccccaatatttgactaacctcaaaaacccacactctacaatgtagattgctcatgcacttcctgcagcgtttacattccaatgccaccgcaacaacggtatttcggagattgcggagatagtcgtattagtcgtatagcttgaaagtttgtccacctcacttgaatcaatagctctcgtgcgtgtaccgtgccgtacagtcctatatacagtcctcatactcgtactactcgttctgtaatgcactcgatgcttgtttatatactgtaccgttatgttatctgtttagtttagtcgtttagtggctcgggagccgtgatgctatgctcgtgaaatagtgtatcgtagtctactcaagtcgagaagaaaccacctgctcggaagtagaagctccagtcgacttgccagccacctcggtggccttggccttgttctcatcctcggacgaagagccgcttcgagactcaacccactccttgtacttttgggccgtgatctccttctgcttctgcacgtagccccgggtgccgtggtactccgtgttgagaatgcggtcccagaaggtgaagaagggctgcgaaaagttggtcttgatgccaaagctctgatggtgaatgtcgtggtacacggcattgttggggaacaagatctggaacgggtcccagggaatgcagtagccgcagtggtcatcgacagtcttgagcgtggagaagcagaagaaccagatggcttctcgggtagtcaggcccgaaaccatgtatgccaggccggctccacacgagtccatcagcacgccctccagagcagtgttgtacagcgctccaatggcgtagggcacatagagtctgtggtgtctggagtggaactttttgtataaccatttgctctggtgcatggcccgatgcagaaagtactgccacgagtcgagaatgaagaaggcaaaggagattttgacaaagggcagcagataggtgtaggcgaacgccgcgagccacgcctttgcggggctcgtctgtcctccaaaccgaacctgccacgtccaaatgtcgtgagcttcatggccagtcgtgttgggctcctcaaagtagttgagtagcaggcccagagccgtctggagcatgtgttgcttgataacgtctcgaacaacctccgcaaacgtgcacttgttgcgcttggtcacctcctcaggagtgtggatccggtactgttcgagcagctcgtactggtcgatgatgtggaacatgatgcccgacgtccagtagcagatgatgggcagcagcagcgcgagattctcgtccgagatccatgacacgagtggtggaatggagtgtttgtagataggaggcggtatcgacgacacgttgggggccgtcagcgttattgggccgagattgaaggtgccgttgtacatgtcgcaaggggtggagctgtttatttcgctggagctggcggtgtagctggagttgttggcgagcaagtcggtacaaatgtagcgttttttttcgtaggtcaggggaagatacgcgccaaagttggaaactcttaattgtaacgtcttgccatttttggtgacaaagacacataaccttctagacttatcagatgggcaggtggagcgatggacagaggacggggttcaagttgggctcggaaaccagggtctagaccgcccatttcccacctggcaaccttcaaatttccgaaaaatcgccaccttggccctctttactgcccctccccccgtcatccgtgcctgcttctacactctcgtaccacaagtttcgccacagcgtagctaagacaagctcctacagagaaaaaccaccctagaaaaacactaatggcaccatacttgtgaagtcaaaaaacagcagtagaatgatcatgtcaagagaccgaggaggaagccctctgacggggacgtataacagtatgaatggtgtcggtgggtggagtagtaggggtagtcacgtgacatatatccctaggcccgtgtcggttccttccttgctcctgattttttcccaattatctgcttttcttggatttatttcgcttgcacattttcggtcgatcgatgtctcgctagacgcgtccccccaaatttcagagttcaactttgttgagccgagaccgagctgagtcagaagagttggtttcgggcgttagtcagcgaagggaagagctagaccgatcatcccgtgactgtcacctcgtgaacgccagttcgaatcccgcgaaaaccatttgcaatttttccctccctccagacctccctcaaaccctaatggagatcacaaatttcacactgcaacatcatctccatcaacaatggcacagtacacaaaagccatgggcaccgtacgaaagtacacgcccgccactctcaagcgagacggtaagcccgcgtttgtgtacgtctaccgacacctccagacgggacaggtggcctacacccaggtccccggcgtgacggagcaccatctcaaccgacagttcaaggaccccaactgggagaacaagcggcccaccatgcgacaggatctgtggcggcccatggccgttgccgatttcggcgaccaccaggctgcttgtgatgcctacgacggcctcgtgtacctgcgatacaagcgaacccacgacggcaagaaggacatcaaggggtggagaaagaccaacgccgccggaaacgtgtggcaggacggccagtaccggcccgtttacacacaggaggcgctggcagacctgtcgaccgtcaccgaggccgtcaaggtgcccgtgaccatccactgggaggacctgtggagacgaggagccgctgagtcctggcctgagaatgctgaccatagcgttctcaagcgatgggacgccatctacccccagtctctggaaaagcgacttgccaaggaagccaaggtgcctggtgagacgactgctgagcagtaatgtacatagttaaggaagtgaaacaaagagtgcgaagcactatggttgaacgggtcctatccatgggtattcgctcacaagacgttatactggcaaagtagtaaagtgtggatattgtagatggtctggcttgagctgtgggagtcggagtacgaaacaagtcgatctccgatatatcaatagtggccggatgagcaggagtctgtaggaagtcatgcagagctgctatagctcgccttctgatactagagactgagtcagcttatgcaactaacaactctgggctctaccattccaccattgacaacaaagtcgctgaagactggtacacatttcaccaatgagcacaacaagtctctactatcgatttctgtagttatcatcagtgtcaactccacaaatcacactttgaacccccactcttttgacaaagcgtaggttcagaatggttgagagcacgggttcagaaaggttcagaaagggtcagaaagggttcagcaccggtcgaaaaagcaggctaacaaggctggatacgagggcagtgctgtttctatacggctatacggctatgcggctgtacgctatacgggtgatagacatgtcttcaatctgtccaagcagccttacggtgttatcaacgcgtaaaacacacttcttcaacaagtgatggtccatatacaattcaatacaatacgagtatcagtatactcgagacaacaacaatgatttagttggctacagtacttttaacgacagttgttcgtgtcgtttgacgtctgattctttttatcaatcaaatattactcttaaatacaataatcctttctagtagtacggactcatacaactaaacccaagtagatccaggcctgtttagctgatagactgtcgggccacgtcttcacgtctactgctccttcttctccttcaactcctcactcatagccttacctcggaacacctttcgcagaatagcaatggtgaccataaggaaaccagctaccatcatgatagaagtgtagtctctgacggcggcaaaccgatcaatgtcagccacgggagttccccaagacgtggacagaagagggaatcctcgtccattggcctctcgaggtccaatatggtggtaagacactccctccgggaacagacgcatatacgagttgtgggtcacgtcaaagggcgattgcttgaagttggccaactgctcatcggtctctgcacagacccaaaacaccaggggccagggggcctcgttgggctcgtatgtctctccctccttgggctcctcgtaccgcagatgcagaggaagagtgaagttgaggttgaagggggttccctcgggagcatcagtgatggggaagatctcaaccaaagcttcggagccccagccctcggtgtggtaacggggttcttcaagatcggcttctccccacagcgcaagaagacgtccttgaccgttggggtgttcagaggtggttctctcgaggtccgcaagctgatacttgtcaaagaagatagaagagggggcggagtacttggcaaacagtctgcagtgtttgactccatcgttctcgtcattgtgatcggtaggaatggcaatgtgtctcagcttgagctccgacttgggatgcagaccaacaggacgctcaaagtccacagacacagatccagcaccgatgttgtgtcgaggctcgatcactaggaaggtctcttggggcttctccttggtagagtcatggagcaggcccttgagctcggcaactcctcgaaaggcgtaggaagtggccaggttgttgagatcgaagatcccgacctccagacggtcgttcttgcacgcccgcgaaatgtgctgcttcttctggttgaagtagtgctcgagatcggggatggtcacctctgtcaccagctccttcttgtcgtgatcaatgtggaaagacgcactctgggcgtagttgaaagtgtccaggtcattcacaaactcctcggactcatcggaacaggcagagtgcttgtccacaaagtggccaaatgcctcgggaccgacaagagggtcgtagtaggtgtagtcggatcgcgactcgatgaaggtcttgggatccacaggcagaccaagctgctcctccaggaacttggccacgtgcaccagctcaggagcagcctcagagggcttctcctcgccccatttgcggggctccgacgcctgcttcttgaccacggtcacgtgcagaccgggctcgtaagcagctgcaaacagcacgggctgctgggcagcactgggtcgtccccatgccactgaaacatcggccacgtggttcaacacgtcgagatcggcgttagaaacgggcgccgagaagcggtcctgtcgaggggcgttgacggacacggtcagcttggacttgttgttgtcgccgggcttgaaggagatcttgtctccatgctgctgaagatcagccagaatagtagctcgtcgtcgcatggtgtgagttgaaagtggttgttggtgtaagaggaagagttgcacaaggccgggggtttctttttcagccgtaaaccgcttaaatctctgaccctggtgtcgatcaatgcagggtcggtgggtgtaggacgcgtatgccgaggtgcggtttttggaggcaaaaaaacgggctttttacataagcaaccgggggcggggtatttgtcacgtgattcgcaagcggtttggttatctagttggcttactactatcccttttctgctccaattgactgatctacactgtgtatttctgaaagtggtttactaacactgggtacgtgttcatatcacgagagctaatttaaataggctcatagtgaggattgcgtaagtagttttaatagactgttttgttgggaattagtggaagataacaagaagcggccatcagagagtaactggcaatattcggacggttttccaggctatagtactgtacagggtgtgtgggtacttttacgtccatattcaccgttacagaacctggtcacgagtgcgaaaaagttgtacaagttctatcacagtcggatcttcatttagttaggagttacttaagaggagcacctacaaggggtctacaataagatgccacagcaagaaaaatacaataattgggcaattatgttcttttgaatgtgtttttaaatgcaactgccaggtatttactacctcttatgccattgcaagtccgagcggctcccatctctatgtcgatggcaggctacatacagttgaccttttagttgagttttcgacgggcatgatctaccgagtaaatgctcattagtaaagcaaaatcggcagatatggcttgattttggtattgttattgccttgaaaaggtctcgaggcgcttattacacactctccacgctgccggccaaagcaccacttttcgtcaccacccagattcgaactcacaacctcccctcacaacaccactgcttggcattgccactgcatagtgccacgacagataatcagataaaacacaccgactacctacaccacctaccgccttacgcaattgacatgtccaacaacacgttgcaagaggcgctgaccgaggtgcggcagcaagagtcgcagatgcgccggtgtctcgaacacaagggcaaaatcatggacgctgtcaaacatgcctcgactcttttggccgagcttcgttcgtccaccctgccgcccaaacagtactacgaactgtacattgtggtatttgacgcattggcgtacctcggcgcctttctcaaggactcccaccccacccaccaccttgcggacctctacgagctggtccagtacgcaggcaacattgtgcctcgtctctatctcatgatcaccgtgggtacagtgtacatgggcatggacgatgctcccgtcaaggagatcatgaaggacatgatggagatgtgtcgaggcgtccagcatcccgtgcgaggtctctttttgcgatactacctgtcgcagcgatcccgagacaagctccccactctgcctgagggagatgagaacgccgctaccaagggctctctgcaggactccatccagtttgtcatcaccaatttcatcgagatgaacaagctgtgggtgcgtctgcagcaccagggccactcgcgggagcgggacaagcgaacggccgaacgtcaggaactgcagattctcgtgggctccaatctcgtgcgccttagccagctcgagggcatcgacaagacttactaccgcgagtcgattctgcctgccattcttgaacaggtggttcaatgcagagatattctcgcccaggagtacctgctggacgttatcactcaggtgttccccgacgagttccatctcgccaccctcgacattttcctcgacaccattgccaacctcaacccgggagtgtccgtccgacgaatcgtcatcaccatgattgaacgtttggctgcctacgccgcccgagaagccgaaaacgaaaccaacactgttgccaagcagttgaaggaggcgcacctagacgacgctgttgacaacgacaaggacggagatgacaagggcaaggacaaggatgaagaggtcacagaccccctcaccgccccctctgcgtcgccctacaccgaagagtaccatcgaggtattcctgcgtccatggacctgttcaaggtgttttgggaccactttctgggactgctcaaggcccggccggatctgcccctcgaagatcagatggccattcttggagctcttacaaagctctccatgaatgcttaccccgagcgtctggagtttctggaccagatcttttctcatgccgccgaaaagctcaaggctgccgactcggctgccacctcctccaaggaaaccgttgatgcgctgctggccatggttctggcgcctatcaacttctacagccggctgttgacggttctgtcggtgccctcgtacctggaactgcttcaatcacagactgccgcttcccagcgagtggttgccattgctgtgattgactctgtgctcaaggagcaggcccatatcaccgatattggcgatgccgaaggtgtgtttggactgctgcagatcctgattgttcctcgaggagctgctgcccagtctgaagacgaagagtctgaagatgtggctgccgaccaggccaaaatcgcaaaggttgtacatctcttgtaccacaaggaccccgacacccactacaagctgcttgtagttgctcgaaaggcgctttctgccggaggacagcttcgaaagtacacctaccccgctctggtgttttccacgcttcgaattgctcgtcgatacaaggcccgggagtctgtgtttgttgactggatgcagcggaccaccgctctgttcaagttcatccacaagctcatttccgatgtctctatcacgggtcgggctgagtacgctctccgtctgtacgttgatgctgctcaggtggctgaccaatgtggagccgaggaagctgcgtacgagttctttgtgcaggcgttcactgtgtatgaggaggcagtttcggactcacgggcgcagttccaggcgatttgcatcttcgtcagtgctctgcagcagacacgcaacttttctctggataactacaagctgttgatttccaagacggctgtgtacggcagcaagcttctcaagaagcccgaccagtgccgagccgtgtacatggcttctcatttgtggtggactgttgacgacgacgatgaggacgacgacgaaaacaaggagacacccgagggtgaagagagcgggacggcgtctgtgcgggacggcaagcgggtgctggagtgtcttcagcgagctctgcgggtggccgacgcatgcatggacgtggcggtgcaggtgcagctgtttgtggagattctcaaccggtacatttactactttgaccacggtaacacggagattacggtcaagtacattaatggtctggtggaggtgatccaaaacaacttcaacgacgacggagcctatgatgctcagaacattgaggcgcccaaaaagtttttcgaccgaacgctcgactatattgctagtcagaaggaggtggatgagcgctacgagagcattgtctggtgactaacgtaatgataatgagatatgattgatgaatgaagtgactaagcgggtctattagccatggaagggcgaagaggcgttggagcgtgaattgcaaacaagctggtacttgtaacggacccagcttttttccgtctcctaagaaggagagcggtaactatgtagctattgaccaagggttaatgtgtagtataaattgaccctgtgtagcattggagaatgagtggcgatgtattcagggctaggatgaggacgagtcctacttcgtagtggttaaaaagtttgtagaagatccgtctacaagaccacaagatggtggtaaacacatacacgacagtagatgaggtagattagtcgctacgctcttctttttttcacgccatgtcactgcgacgcgacatggtgctataggtatagatgatagctatgttttatagtccagaaggggaagaatgtgccaggtctatatgtacatcagagaggctcgacgatattacgatatatcaagaagtaaggatgagttacggtgttactagttcacgttccgtatagaacaatatagcacttccactaccgatagtgctacaagtcgtgcccattaggcagtcagtggtttgagaaagatgggctagatgtagatggttgtaacatactacatgcaaaaaggcataagaggtataaatggcgatggaatagaaaagtctgttgtatttgtcggcctgttgatatataccccccttcgagtcattgattcaaccacaccacctatcctcacaacaatgttcattcctcttctgctgctgtcgtctcttgttgccgcttccgactgcgaagatacacccatcaacaagcgaggcatgattcagtgcgtcatgagaggtgtcgacgagtccaaggctccttctcatccggtcagccagatcggaaatgcacccaaggctggagagacccaggccgctcctaaagctccccagacacctgcccaggctcctgctcagggagagactcctgctcaggccaactacgcctccaagccttctgtcgagattggtcttggagtggcccttgccatgtgtcttcttttgtagcttcaagtagttaattgacgtttgttggttctcaggttgacttgacattgtaggcctcccatctctgtctgatacagagtgttacactagcccaaattctttggtttttcgacagatgactttccagtaagctacaacggatatccaagacggacactaaaaggaagcccaagtcccggcatcatttttggtgatcgtggaaggagtctgggactgaaacagtgatcgacgatggtctgaactcaagaatacgaggggagacagtacggaaaagatggaaatttggatagttgaggactggttttaattttgcttttgttctccattaatcaactccctgggtcgctgacagttgtgtttacaatgtcagttgtgcaacataaaccgcaccaatatgtaacaagtggtggtcttgtacaaacaggaagaagttgtgtcagaaagaaacgaaccagctaggggaatgacatgaaagtacaagtagttgactttcaactctgtgttcctccaccagtacatgtgcttgtacatgtacatggtcatgatcgacatcaagcctgtcttgcaattattcgagatactgaacacatacagtcaatgaatggaaagagaatctctatgaaacacatcagtactagtagcaacatattataaagaccttactaacccacataccaaacaaaacgagcttcaaccgccttacatcttccgttcacttttagttacatctccgtttcacttttagttgacattagttgaccccaattactaaatcccaacaaaatcccacctcaacaatgcagcttacagtaccaactccaaaacaacgagatgtgttcgcatacagccgaacacatcacgtggccaggaaatctccagcacgtgaccgtctcctccctaccatcatctatcagtgacgtcactcgtcatccaataaaagcgtgctattttggcacctttcactgagtcaaaagacgcatgccaacattgagttacgatagccgccgtttgcctcgtttcgagggagtacaataactaccgcaataatgctccaattcagacaaaaataacatattcagaatcctacaagtcacacaataacaataatgtagtcaaaatacaaataagacaacatttacaccccgaaaactcgaccaaacagcccagcaactgacattaaagttccctcctcgatggtggggtataccgaagcgagcggcagttgtttctgaagactgagtgggagcatttttggagaggacaagagaacccgctggaacagaaggggtagagaggagagtcacgtgatctaccttatcaactgctttttgcgcacatggtccagtcctctcccctcttttttgctcgctctctcttgcttctcttagtattgaaaaatgcaaaaaaacttttttggaaaatataggcgcgttgtggaggtgtgtttgcaagtgtgcatgggtgtgggtacaaaacaagccagacccacgactctgccattcatacacacacaaaatggaagaacccgtgatctacgacgagaaccagattgacgacaaccgggtggtcaaggatctgattgccggcacctgtggaggagtggcgcaggtgctttcgggccagccgtttgataccacaaaggtgcgtcttcagagtgctcctgagggccgatactcgggagccatggacgtggtgaagcagatcatgaagaacgagggcttcaagggcttctacaagggcactttgacccccttgattggtgtgggggcctgtgtttcgatccagttctcggtcaacgagtacatgaagcgaatgtttggtgctcagaacatttcgctcggtctcaaagacacccggctcagctcgtggcagttttaccagtgtggagctgcggccggttttgccaacggtttcctggcatcgcccattgaacagatccgtatccgtctgcaggtccagacggccgacaacaagctgttcaacggacccattgattgcatcaagaagatgtacggcgccggaggcatccagggcatctaccgaggcatcatgcccactcttgtgcgagagtctcacggtatgggcatgtactttctgaccttcgaggctctggtgaagcgagaaatggccctcaaggactgccagcgaaaagacatccccggctggaagctgtgcatgtacggagccggcgctggctacggaatgtggaccactgcttaccccatcgacgtgatcaagtccaagatgcagaccgactccattttcccggccgagcgaaagtacaaaaactcgtttgactgcgccaagcagattctgcgagaccagggcgtcaagggcttcttccggggctttggacccaccatgctgcgagccgcccccgtcaacgcttgcaccttctacgcctttgagcttgcctgcagagccatgggttagagcgacgaggagacaaaagatgatatatatatatagacacatgtatattaatgattgatagaccgaacaagagtggttaatgtgcagtttagaggctgatcgggtggacaagggcgacggttgcagcacatgctcaaattgcaccataaacaacgaagtacaaatagcagagggaaatggagatgattcttcgaatctgtggagcgagagggttctattgaggtcttttaatcgcccatcggatggaaattggccccttgagagtgtgctgttgagatgtgtgttgtacatataaagattatgacagtctatgagctaacgagacaagacttatttgctgtatataatgttgaagagggctagtactcattagcaagtatatgtttcttactagggagtttctgccttctctcatatctctttcagtgtaacatttgtccagcactacaataccgcttccataccgtttttcacattcaatgtactatttcgatcgtcttatcgagggtacccgaagaccgcatgctcgtagtattgcacattcaaatactacatgtccgtataccccgtcagtattctctcgcttcgctaaaaaaacacacgctactccaaccgccggagcaggtagtccacctcgaccttcttggtgagtggaatcacccactccttgtagattcgcttgacaacctcggaatcaacctttccctgggttctctgcgaccaccggagagtggggtctgtgccgtaggccagtgccttttctcccagccgggccagaatcgtctcttccaccttggagtttgtgatggccgcctcaataccagcaatgtccttgttcttgatgagctcggtgaatcgctcggtttcactcagaaacttggactcggccacaaacttgccaaagtggattcgtcgcgacagcgcctgcagcgtctcgatgtcgcacaccatgaccgacccatagttctcgggctgatctccagtgccagcacacaccaggggcacaatgtcgtcggtgtaaatctttttaatctcgtcgttgacgctcacctccttgctgtagggcgccagaattggcgcataatcgatggggggcagaatggcctcgggcagatcgtcggggaagaaggcctgctcgtccggggcagcgtaccgacgcagtttggcgtgcaccttttccgactcctgcagaaaccagtcgaggtaagagcccttgaagccgggaatgtccgagttgccggccttgtacacaaactcggaacggcagaactgagcccgctcaatcagattgaagacaatagtgtcctccattcggaccagcgagtctcggatgttggcgagatccagaacggtgtcggctttagtgaagtccattttccggcgaatttgggcagatgcaactgttgtgagggtccgtagcgtccgtaaaattgttgcagcgtactctgctagtggagtttttcacttcaactgtatggtatgggactaccgttactgcagacaacgagcttaatgagtcagactagccctgacactttagtgtcccttgtgaggggtaagagaaggaggaaaagagcaaggggaaaacaaccacacttatatacacggcaactatcgcggcacagaaccaacccaccagatggactcggaaacacggttgctcttaaagacattccgcaacgctgaccctaacccatttcctccacccttatcagtacggctcacaaatgcaggctcggatcggtcggccgagagcgcacgtgacctggaatgaagacggcgagaagagctcaatgtggtatttgggaagaacgtgtgggtcgagcgtacaatgccaactgatatatctaggaaattgttaccgtaaatgtatgttggctgctagtggacactgaagggtataaatggcatattggatgtgaaaataacaatcagaagaacgaggggatcttaacggtaccaaaatcaccaacttttcgtggggggttcgtgaaataaaacagttatttataatgtcacggggatccaatttcgtcaaatgtgatgttatcaactaagatacatcttcttcatgatcctttatcattgaatgatggagctagtcagattgtgtagattatagcaccttccaaaggtcaattgatgatgatgatgagtacataagaagtacattctcaaactggtgatttcatactgattttagtgctacaatcgtctcctacattactcttccataccactcacaactacacatcatcataaatctctctcttatcttctgttgcaatcaaacagaccctccaaaagaagtaattaaagaagtaattcttggctttgagagctgaaaaaacttgataaatatatatacaagcgtgtgtttaaaagctatccacaaatttcagcccaaatttcagctaaatactgtcccaaacaacacatctaactcgtctaagcgcccgccaaactccatccggtccgatatagtgtaggggctatcacatcacgctctcaagttgagaaccgtggagaccggggttcgattccccgtatcggagtaaaccagaagttcctgcttcttttttgttcttcccagagtgtatgtgtaggccgacccaccattttttggccatccaatggcattgcttacataagcttgctttatccgtgcgactcaccgtgactcaactgaacgactcaattgagtcacgacaaccttaatttttaccccgaaatttaaccgagtggagaaagtgccagggatccactcagtagcactatataaccgcatttcatctcttgatctctttcccaacacatttttgacatccccaacatgctcaagcaactggaaaatattcttgagtcgcgaaagcacaaaaacaggttccgaaaattgacggtcatggatcctgagtcgacggtggatttttcttcgaacgattttctgtcgctcggaaagtatcaaccattcaaagacagcgtcagtgtcaaggtggcggatttctgcgcccaaaccagctcttctctgggttctggagggtctcgacttttggatggaaattgtgcactgtacgagggtcttgaacgtcagattgcagcattccatggagcaaagtctggcttgattttcaattctggattcgacgccaactcggggtttttctcctgtcttcctcagcctcaggatatagtcatttacgacgagttgatccatgccagtgttcatgaaggaatgcgtcaatgtcgggcaaagaaacgggttcttttcaagcacaatgacgtggaggactttgagcgggttttgaaccagtacaagggcgaatcaggcaacatttttgtggccgtagaggctgtatacagcatggatggtgatacagctccgttgagacaactgtacgacgtttcagaccgtctgaacagagagattcttttggtggtggacgaagctcatgccacaggtgtacttggagaccagggacgaggtctggtgtgtgctctcggtatggagaaacaggtatttgctcgaatccatacgtttggaaaagctctgagtgccaatggagccattattttatgtcatcccgtggttcgatcttatctgatcaactatgctcgttcttttatctttacaactgctcttggtcaggtgaatctgctcatcattcaggccacctatgagcttctggaaacccaggcagcagcacatcttcagactcaactatgggacaatctgcagcggttttccacggggttgaaggacactggagttcacgtttatcctcctgtgccccggtcggccatcttttcagtcttctgcgacaacccgcggtctctggcggcccactgtcagcagtctgggctggttgtgagacccattgtgcatcccacggttcccaagggaacggagagagtccgggtgtgcattcacagtgctaataccgccaaggaggtggacatgctagtgcacaggattctcgagtggcattctcagaaggagatgagagggcggttgtagagggtacagactctcctaggagtagagggcaatagaaattgaagatacgaaatctcgatagtagctatggaagttatctgaggcttggcagtgccgtgtggtttcaactggtcttgtcagattgtaccagttgcacatcaaggaggtgcggagatagacaatcaggagataatgaggtggtcaggtggacttctgtgctgtaggagaacaagagaacaagcaacaagcaacaagcaacaagcaacaagcaacaagcaacaaaaaacaagcaacaaggtgaacaaaaaaacagtacacgtcgtcgttcagtacataaacctacaaataaagctttgacaagtggcaatagggacccttgaaagccgtgagaagttctgagcgtgataaagaaccgtggcttggtattgtgaaaggctctggccagccacagttgacttaggtcacctggctctacttgattgatataacaattggggttcgatagtatgctctggatgtacggcttgacatcgtaatgcgtgctgtacgtgccacgattggactgtttgaagataaggtagctagccgtgtgcattaacgagtacgagtacgagtacagtgcgtctgatattatatataaacaacaacaaaaaaaaaaaaaaaaaaccattgcatgtgctggtaccggtgctagtacataacatacatgtgctacaagttgcacattctttcgataacagcaacggtacattgtgagctggctcgtgtgcaccaagatatcggttacttcacgtctacagtagatggtatcacgaccccagaatctgctggagccgtgcgaaagaaggcattggctgtttcttggcgagatagtgtcatgaaatacgaggggtagagcgccggataggagcgtcactggttgcagacaggttggcgaaaacattcattcatggaggaatggtgtacaaggacggaggttgtttagctcccaaccgcccggccctaccgttgcaagtgtttcacttcctcttgcagtaatgatctcccgtgtctggtcagtgtcagacggcggaggtgatttgtgatcttctcatgtcacacgatccacggagacaaaacgagggagtgtgaagctcgctgaggagtgatttccccaaacccagatccacacggcaccagtctaaagtcggttgatggacgctagtgacgtgggagacgctagtcatgcatcttgacaggtaccagtaccattcagccgtgccggagatgtttcgtgaaaagtttatggcccctgcagaaacattcttctacccataacatgtccgttgggcatcattacggggagcatagcttctcaacccaacgtcttgacatggagcattcatctcgcccccaagtgcgatccgccctcatggcccaccccgtccatggcttggcgcggcatggtcaatgacgtctcacgtcaaaaagccaccagtaccagctcttgtctcctttcgtcttatcagcgctacttcatcttggcatcttgatacgcacccacacggctccatagaccagataccatgaccaacatatatacatagacgaaacgagcgacaggatggactcaccaccaacatgaccgacaaagaccaatatccgaccaccgtgtcggaggtggccaacttttccaccaacaatgataaggagcagtacgtgaccgacgtgactgaggtcgactcgtctgtgctcgcgtggatggccgaacagctccagatccccccctccgatgacgacggctcctactcgcccgaggtgcactttatggccgctcgattcgaggagatgaacttcgaggacgcctgcaaactggtgcgagagaacatgaagtaccacgacaatgacaacaacttccgagacgagtaccgtcgggaaatccgagatctgatggaggctctagactccgtgggtggcggagacgacgaaaaaatgtcgctggacgacccgaacaacaaggtcatgatggttcgttactgggccaccattttccactggtggagtccgtaccctgaggttcgagccgtcacagatccccaggacgacaccgagtgcacctcggagacctggcgagtgtgggtgctcggaactatctgggttggcattgctgccttcatcaaccagttcttctcgcctcgtatgccctccattggtctaggagctggtgtcatccagctgctgctgttcccctgtggtcgattcctggaatatgtgctccccgacaaggggctcaccttccgaggaactcgatactcactcaatcccggtcgatggagccagaaggaacagctgctgaccaccatcatggtctcctgcgcctccggaaccccctacatcacctacaacctcatgactcagatcctgcccagcttctacggccaggaatgggcccgatctttctccttcggcttcgtcttcatgctatccacccagatgatgggtttcggtctcgccggtctgctcaaacgatgtgctgtctaccccgtcaaggccgtgtggccctctctgttgcccaccctggccgtcaacaaggcgcttctggcacccaaccgaaaggaaaccatcaacggatggaccatcactaaatacaagtttttcctcatcctggtggcgtgctcctttgcctacttctggctgccaaactacctgtttgaggctctgtcctacaccaactggatgacttggattgcccctgaaaacgagactctggcgcgagtcactggatctctccagggtatgggatacaaccccattcctacatttgactggaacatggctactgcggcctactcacctgtagccatgcctctctacaccgttctcaacgactacattgccgtgttcatctctggtcttgtcatcctgggtctgtactacaccaacaacttctggacctcgtacatccccatcaacaccaaccgactgtacgacaaccagggtaagccctaccaggtgatgaagattctgaccaacaacagatttgacgatgaaaagtaccaggcctactctcctcccttttacggagctgcaaacctggttgtctactcgtccttctttgccatctaccctctgtcgtttgtctacgtgactctcatggaatgggctgccaccaaggaggctctggtggagactgccaaggctctccgacacattcaccgaagcaactacgagggtcgagtcgaccccttctcccgatacatgcgaaaatacaaggaggtgcccgactggtggttctacatcatcatggtgctcatgtttgtgctctctgttgtcatggtccaggtgtggcctgttgacactcccgtgtggaccctggtgtttgttattggtctcgtactggcctttatcatccccttcaccatctttgctgcctacaccgccaactcgctgtctctcaatgtcatttccgagctcatcatcggttatgctctccccggatccttcatggctctcaaccatatcaaggctctgtctgtgaccatccagatgcaggcccagaactacgcgtcggaccagaaactaacccactacgcccacttgcctcctcgatccattttctggatgcagatctgggccacctttgtcaacggtctggtctgtctcggagtcttgtccttccaggtggacatgcccgacatctgtgagcccacaaacaagtataagtttacctgtcctggagacactaccttcttcaccgcctctgtggcctggggagttattggtcccaagaagatgttcgacaagtaccccgccatgaagtggatgttcttgcttggagctcttcttggtgtgcttttctacttgctgcaggtgaccctgcccgccttcctggccaagaagtacccttccaaggaaaagaccatcgacaagatccgacgacagctgctctacatcaaccccatcattgtctgcggaggattcatggcctgggctccatacaacctgtcgtaccgaaccggcggtctgtacctcgctttgctgttcaacatgtacatcaagagccggtacctggcctggtggaagaagtacgcctacattctggaggccggaatgggcactggaattgccatctgtgccattatcatcttctttgccgtccagtacaaccccgttattgttgactggtggggcaacaatgttccctatgtcggagtcgacggtactggactttcaattatcgagcccattcccgatgtcggctactttggtcctgctccgggcaactacgattagccggatgggtccggttacaacaacgcttttagcgattttatagtgaattaagtgaattttcaatttgtgacatgtaccgcaacacaggaggtcgatgtgtaaccaaagacacaagtcttcaccatcgatagtccccaacagtggtcacttatttccactctctgatttggattttcgtattattacggttaaatagtagactaatgggtccaaacaagcggagaatagggcggagagacttcgaatcgacgcgggcgtaagctggaacgggttctcagtcttttacagccttgttctctctcccggcagatgcgccccgcggtctctttcgccggttgttcctgctgcacgcaatagttaacgtttgtaacaagccgtgaaacttagttggaagtctaactatggaagcaaagaggtaatgcaaaaatgtttaacataaaaaaaaaaaaagggcaaaaaaaagaaaaaacagccgaacacggagacgaacagtacgaggagacggtcgcttaaaagttcaatggggagatcgccgagggtcttttttttggtggagaaacatcggagaaatcgcaccgacaataaaaataccattgtaaggaccgtacccacacaaaaaaacctctcccccagtgatcggtatcgagttctacccgtgggtaggccacgcattgcactaaagacttacgtcaatctcccgcagcgcacttccataccaggcccgccttttacaacggccccagtgttttttctgatgacgctgttccatgtttccacatggcactctcacgagacacggcccaagggtcgttatagagagaagagaaccaccgaatttcccacctggattcgaactgcagagcgcagtcttgtgtagccaggtacgcgaggccagagggagaggccgggtaactgcagtctgaccgttaggccagagctaaatttcccgacattttaacttttttaggccgtttcatcggacagtcgtcaggaatgactgtaatcaaagattcagaagtgtatgatttattgaacgccaataacccggcttactaggtatatagctgtaatgaatcattagaataaaaaatatataaaaaatatagtcccaaaggggtgttgctccgaagcctttttccttttccttatatattttatatatactacattgtagtatatatttttttgcaattgtgcaaaacggaaccctcggctaaacaaagttagagcagccactccaacaaagtctacggaataatatgatcggccctgggttttttataggaacgctttaccccgctccgtctcgaagagcaggcgggatatcgtgaggtggaagtgaagagggcagttatatgagcggattatgtgggcggctaatgacataaaggcggctaacttgtgttttaatgtcgcgtttgtttgtctgcgcggtgctatatgttgcatctggagctcattccgcgatccttcggcacgtctgagggtcctattttccgccctgcttttgctttggatgtgcgacgtgagttgacgtacccccctgcaatgttccacgtgtgaggtaggcgtcagagggactaaatgaaggatgtgcgaagggtgaggtggaggtgatgataagcggtgcctggggaaggtggactggagcagatggaggagagtggctataggcatgaaaacccgacaagtggtccatggcgcattcattgatggtctcgtccacgccacttttcaggtctattcatatcatacactccctctcgtatcaatgcatagtttcaaacaccctgccaaacacccttttatgttttcttttggcaatgtttcacgtcaaacagggatctccatggacatgaaacgtgtaaacagagcagagacaggtgttttatcgagtcgaaacgggatctaaacggcaggcccggaacgcccccaaaacgggctcgagtccacggaatccgcccattcacgcacatccaatagccgttatctatttctcaagagtgggcggttgatcgttcagaagatctggcgacgatccacagcaccaaactcagttggtggcttgcggctctgcggcagtcgtttgggaaggaaagacgtgagtcgcgacttctccttgctggtcgatctgctgatccaacacggtagggtccaaagagtggatttgatggggtggatctcatgagatactattggagactggcggcaatgtcgacgaggagatgtctcccgagaatccaagagcctggggctccggtacacacccgattctagcccacaatagcagacggacattgaactctgcttggtgatagttcctggttcaaactcaagctccaaccaagagccggataagctcccactaacctctgcacttagtcaagagctgtcagaagagagagactgagcccggtgttatatagaggaaggcactgcttccgggcaagagagcatcttgtctctcaagcaatgaagctctttcactctctttccgcatgcttgcttgcctcagtagcgctggccgctcctgtggtggacctagcttctcgagaccagcagatcatcaacaccttccaggtcactggtcctaacatccaactagagtcggttgacaaaatccacctgtggcagcacacctttgctaacagttatggagcccccaaggttgcccagtacactccccccaaccaggactttgaccgtgtccgactgtcctacaactcctccgtcaccaccacccagtacgacagactcatccaggtgtttgttggagataccgaggtgtggcgttcttccactgccgagcccgtcggttcccccctggtccagtttggttttgagaaggacgtttccgagtacctggctctgttcaaggagcctcagaccatcacttttgtgcttggcaacgtggttcaagacggtctgcagggccagtttgacaccaacttcttcattgagttcctcaagagcggagacggaccccaccctggtacccagatcggaggagctcttacttggaattacggaaccggaggcgactacttccgacctgccgacgtggtccatggcctgtccaagggcaacggagactcgtactctttccccgacgatactgccaagacttccatccagctgcctcgaaacaccactcgagcagttgtggagatccatgcgtccggaaactccaacgaagagttctggtacaccaacatgttcaacgagctgtctggccaggatggagacggaaacggaggtcccagtcgaattgtggaggtctggatcggagggagactcgctggcgtggccttcccttaccccgttgtatacactggaggcatctcgccttacttctggacccccattgtgtctccccaagcgttcgacggcccctcctaccgagtggacgtgacgcccttcctgccctggttgtggcagggaattgagattgagctcaagctcaccgctcagtacaccgacaagccccagaacgcgcaacagaactggtttgtgaccggcgctctgctggcctggaccgagttgggtctgcagggctccggcaatgtgtatgtggcagataacacccccacctacactccggcctggaacaagctgtccaactcggacatggtgcaggtgtcgcacgtgaaccgggtcgtcaaggtcatgtctcagctgcagttttcttctccccgtggcaacctcaacgcccaggtcacctggaaccagaacggaatctccagcaacatccagtactacacttcgtcttctcaggctgttctgcagagcaccaagggttcggattcgctggaggttgtgctcaatggcaacacccagactgtgtggaacgcctcgtacttttaccccgttgtcctcaacaccattcagcagggtaaggtggccaactccgacattgtcaccggttacgaccgagtcaagactggagttgcctacgagcgaaccgtactcaacgctacctcgcagatgggtggcgactcgtcttggggcacaacctaccagtcgtactggcgatctctagctggagcctacgacgtgccttccaactacgatgccacctactactccgaggaggcccaggccgaccacggcaacctgcagtaccgaaaccccagttcgtcgggatctgcaacctcctttaaggatggcagcgtgctggacaccatcaatcactacacggatctcgtgttcgccagtggcaacaaccaggacccctgggcgtttgctacagcactgtccaacgtgatcaaggctctgggatactctcccgccgagatcccgtcctcctccaacgacaagtcgtttgccatccagtcgggtggagattcggactccaacgccggcccttaccgaatcgtcttctccggcggcaacggccttcatcagcactagacttcagcttcttaatttataccctacaccgccactcactcagcctagagctcggactttatctaatgatatcatgactttcgttaacaggatgggtagatgtagacatgagtagtccagacacgtccatgtaatcgttgtgtaccatgcgaagacaagacactagagagatagaccttgacttctgttaatagagcgatagacctcgacttctattaatagagctatagaaccagagttttcaactctttcttgtttgcaagtatgtacttgtaccttagcaagaatgtgtttacatcgacattgcgatcgaacgcgccgttgagctacctcttgtctacttgtattagcgacaacgatatgaaactgatatgttctcacctgaaacaaacggtattgctttttccacaaccagcacaatggatagacctgtgcctgtaacttgtcttaccgtcgacaggcattagttatgagtgtctaggtatcagcgataggagatcaacatccatataaatgtatattcctgtacgagttccgtacaataccaacgagtacggtacaataccaatgcaattgccgtggtacttttcgttcacctccctagtcgttcttttcgtgaaactgccggtgattctcaaccgacaatgacgtaattgcaatatatatccgccaacaccaacatgaaataaactgacgcgaaaacccacggaccaagccctgcaaaagctatctttatacctacaaaactgctacaaacctgttcttgctctggttttactgtaactagagtcagacagttgtaccatctaaccagcagaaacgccgagcgggtacccatgataaacctccgactatcctagatataccaccgactatctatgatataccaccggctatgaccccccactgacccccactcgccatatatacctcataacacgccggtaccttgtccacattccaactctacacggccctctgcggaatccgagagtttgaggttcgctggtggaggaaataaaaaagcaaagcgagacacaaccctgagacacgctccgtgtgtgcaagcacatgctgtggggtattgtcgatcggcgttgggttggcttagctaagccgccttgattatgtaatcggcaagagcgccactgaacatgttaccacacagtacactgtgcaacgtaattacttaacctccataactaccgaaggtgcggtacaagtacctacttaatacgtgcgaaccggtaatagaaaccacattgtattgcattgcactttctactcagttgatacttaacatagtatttaattaagaggataatgagcgagataaatacactggttttgtgattccgttttcatcggccggacccggagatgaagaatatccactcggttttcctccatggtgtctccatgtcattctagagacatctccgccttccatctccccatgggatggactattcggcccatcggaacaaggttgcatggtgagacatggaacgatatgaacgtgaagtcctcaagtgtcctactaagagggtagttacagagctacttgagacgttttaatggagacaatcaattgttgaccctgtactgcgcacgtgaccgggcgcactcccgcgtaatctcggttatcgcacttaccctacagtcccctttaggcaaccgttcctctcccgtatcgccgtctgctgtacagtagctgtgcactgcgcttttgttggacccagtggtgtgactagtgataggcgtctggcgtgagtttcaactgtggagtagcaagtcgtgtgaacacaaacacaaaacgaaccgaggcttatatatatgctgcgttggatcctgtccccgctctctctctctcttctcttcttttcttttcttttcttccataacactacaccgtacaacgtagtctagctactttacttattacacacaagagcctgcacccacacacaccatccacttatcaaactcaaacctatatcttgactctatcagctccacacacacgacacacgaccccctcccgcaacaagaatactactacaccatgccagtctacggagctcgaaacgtggacaatgtgcggatcggcgtgatcatggtcggtctgccggcccgaggcaaatcgctgattgcccaaaagattgtccggtacctgtcgtggctgtccgtgcccacccgctgtttcaatgtcggcaactacagacgcaaagaaacggcccatccgacggccgagttcttcgacaacgccaacgccgtgggcgaacggttgcgacgtaacgccgccgaggctgcgctcgaagatatgatccggtggttcgaagaggacggcggagtggtgggagtgtttgacgccaccaactcgacggtggagcgtcgcaaatggatcgcagacaccctgctggacgccggagtcgagcccatgtttgtcgagtcgtggtgcgacgacccgtcgattgtgatgcataacatcatcgacgtcaaaaccacatccccagactacgtgggcaccgacccggaaaaagccatcaccgacttccagaaccgaatcaaaaagtacgaggcagtctacgagacgctgggcgaaaacgaaaccgatctcacctacgtcaagctcatgaacgtgggcgcccaggtggtcatcaaccgtatccagtcctatctcgaatcgcgtgtggtctactacattatgaatctgcacattaagccacggtacatctggttgtctcgacacggagaatcagaatacaatttaggaggacagcttggtggcgactccaatctctccgaacggggacagatgtacgccaagaagctgccctcgctgttacaaggcgcactggaacaatctgtgttccccgacggcaaggttcccgagctcacagtctggacctcgaccctcaaacgaaccaaccagacagcgcggttcctggactaccccaaacggtcgtggaaagccctggatgagttggacgccggagtctgcgacggaatgacgtacgaggaaatcgaacagcagtaccccgaggacttcaaggcacgtgatgacaacaagtacgaataccgataccgaggaggcgagagctacagagacattgtgatccgtctggagccgatcatcatggagttggagcgccaggaaaacattatgattgtgacccaccaggccgtgcttcggtgtctgtacgcctactttatgaatgtgcctcaagaccagtcgccctggatgcaggtgcctctgcattcattgattcgattggagctgagagcgtttgacacgattgagacgagaatcagcgccgatattcctgccgtttcaactcatcgagagaagggtagtagtgccaagcatgcgtaatatcgcgcgcgacctcgcacgcagccttgtgtgcatggatggctgatatgtttgtgcacatatactgtgatgacacgagtggatgatcgccggccactcattttacgagatgcaactagggagccaggtagccagtgtattggacttggaatcttggataataatagatatttaacgatgcaagtgtagagcgaagctgcgagcgctgctgaaaccactgtatatatcagcgagtagaggcatgtcttgtaacagagtatcgacgcccattctccaagtcgctatgtccgccgtgaaagtctaggtgctagtgtatagtctcactacaatgggttcctgcgtgctcataaagtgcttcttgcttcatatactagtcgcgccaccagacaaaccataccatatgatacttcgccttgaattactacattgcaagtctcgtccttttagtcgtcttatatctcctcgggtgcctgagatggtgaagggacagtttgttgctccatattctgaaacattcatccgcatgtctcaaaagactgggtacgagttgcactttccataataatgcttgctattactacccatttaacactcgttgatcagtcttgcaactccactcaactgactcgttcgcataaaatcgttttcttacaacttctccacgaccgcattcttaatctctccaatgaccgaattcttggtcttgtcctgccggccctcgactagtcctccaggatggacaatgttggtcttatcccaggccttctgggcgctagtcttcttctttctaggggccttgacatctcctccctcttcgtcaatgttggcgtacgactcgcccaccagctcctcgtcagtgctgtagtcgtcctcgttgaggtcgatgtttcgttcctcgggcagcacattgtcgaaaatctcctccatccagaatcccagcttgtggatgggagccttggcttcggggaagaagggcaccatgttgaggaagccatgggagtagcccttgatgatggatacctcgactaggtcctcggggttctttctaccggagtccctgaaggcttgtcgcagcttggctccaaacagaacagtgtcatccaccagaggatccacctcaccacagatgatgtacgtcttggggaactgtgcaagcttctcttcgggtgcgagaaggggggacattaaatagtccttggacagatcacactcggtgtctccagcgtacagcatcagagcagtgtacaaaacctcggctgggagaactcgatctccggagtaaagcaccttggaagtaagagacagtttgtttccaggaccctgttcggaaggagaaccaggctgctgcgactggaccttttgctgctgagccaggttaacaaacgacttgttggctcgaacagacttgtgtgcatctccagcgtatgactggtacacgtccttcttattcttgtagaggaacggggtggcagtttccttggtcacctgtcgaatgagcttcatctggtcctcggacagagcagaggcaaagttcatatcaagagcagggtaggtgagcaccagaccagcgggtcgcttgatcttcttggggtaatcaatgagcttgagctccagagcagcggcgagatttcctccggcagagtctccggtaacaacaacctcaggcacgacatcgccactgagaccgatgatggtgcccttggacttcatgagcgcgtagtaggtgtcaaagacctcgtccagagcgtaagggtagggaaactcgggggcctttctgtagttgaccgagaggatgggcaccttgagctgggttgcccaggcaagcagatagtcctcgtgcagcttgggctccatggtggtgaatcctcctccgtgcagatggtagatgaccttcttctggttcttgagctgctcggcagttccgtcaaacagaagcagacactccacgggctcctcatactcggaatgggcaggtcgcttgacaaacacgtccttgtagatgttgattttgggcaacagcagcttggcaatggcgccggcgtacgggtttcggcccttttcccatgacacccggcacgattccacggtggtcttgagtctgtatcgtcggaccttctcgttggcagcgtccgagaagatgaggtagtagacggtgagtacgatggacagcaggtctcgggcgtacttgttcttgatggggtaggcggtccagaagcccgcgtccagcgcttgcatcacccatgtggcccggtagaagccgggggtgtagtggttctcgaatgggatggggggcgtgaggccaatgagcttgtcaaagttcttgagcaggtagtagcccgtgagcgtgagcacgtagatttgccacgcggtgattttggcggtgagcgctcgactcagagatcggattccgggagggccatgtttgtttcctcgggtgatgatgagccaccaggccagcgccacggcaaagcactggacccgcttgaatttcgcactggggcgtccaaagatttcgtcaatcatgtttgtggcgatgaaagactgggtttttgtgaagaaaaggtgcttttagagccaaccgccggggttatcgcctttagctatcgtgttcaaaaaaccgcagctagagcgcatgcagagtcaattggcgtgcttagagtttacttgacaaggcgaacgtgaaagacgtgttagcggggtagttggaggagacggtgggacagtaccagcaccaatgtgcgacacgagatggaatgggtccggtcacgtgcgccctgtatatatgagccccccccaaaactccctggctctacatatatctccatcctttctccacacccaactcaaactggctgtctaaccgttcataaatgtatgcctgtagtcagttgtacttggctcagtcgtaattaaccctttttacggcgttatgtatatattcccgttatcctctattgtggggtaacttagtggcggtagggtaaatgtgccgagaggagaaggaggagagcgagtaatggcggctatgttaggagataggcacgtgactgcgggtgtatggataaagcattaaaaggtcgtgttactaactgtggtattttcatttctcatattcccccagtttgtgtctctttcggtctctgacaataatgtacagatggcggtatgagaacataccatgaccctaatactgtatacgggacagttcagactcgcactacacaagaaaccccggcctcggctgaaattaatttatcagtaatcgaagacgggtttcaaattaatcatcgtcagaaagcagccatcccggcttttctccacattaaatgaccgcaatacaccccctgcatccgcaatctcagagctacggtaccaacttgtacagcaatctgagtgcattcctttcatagctccgtcaagtgagcgtagggaagctgaagtatgtgggtttggactggtatgatatgggatcaaactaatgctcatactcgtactgtatcgcgagcatcgtaccgggtggaagggaccttttgccactggtctggatctttgctgaaggtacaattcaatgagtggtctttgatacataatattgtatgtactgtatgtatgtattgtacgtatgtactgttcttgtagctgtgagcatttcctagaatataaaaaatagaatcaaaatagaatcaaaatagaacaaaaaatagaacaaaaaatagaacaaaaaatagaagaaaaaaaaaacaaccatattggcaaaaaacccaatgcaatctaaggagtgctctgagtgatattcttcgacataatttgcaagtactcgtagcgtacttgtattttccaagtttcgggaatgacccgtgaatctgactccgctgaatctgacccggctgatatgtggactgttagatgcttcaatacactcttttccaacgctctggaaagaccctacagggagaacttctgatcctgaaagccgtttgaagactctccattcttattaatagtcttattcaagagttggacagtccataccttcatccctttgggcgttcatatctccacacatctagtcttatctctatctcctgaatcaaacagtggtgttcgctcctctacaggtacttgtcgcacaccattgtaccagttgtggcttgtacagccacggtgtaacgcaactctggtccatgttgagcatactatccatctccgctcaaacgtatcctgacatgtacctttaggagtacctctcgacacggtagagcccctgcgctcaagtccacctgtctcatgtccagccgccaagaagacccgtccgctgccaaatgcgagtgctccggaataattccattagtgtcactgttgcagagataaggcacgcggaacacgattgggttcgtcgcagagggtggagtgatggacattgatagacaatggtggaccaagggggacaatgatggacgagtgtgaagagtcgcttggtgcaagtgtgtacaattcggcgtaattttcggtacgagcatcacaagatgctacactcttggagcccaccgtgggtagaacatataccgacctgcatacagcactcctgccggcatgtatcaccccatcgtattcgcttcacctgtcgacccgtcatatccgaagtatccgtttatccgtctgtgggggtatggtggtgaagtgaggaatgaaacgaggaaacaaagtcagcgtgagtcttccaatcgtgaccgcgagagtaccaggaggcgtttcgtgtcatgtgacaagtagacaccatagctcgactgaatacttgtattgtggtcgtacgactcgcgaacacctcaatacatccgtctccacggacaggctgcaactactcgatcatccacaaattaacgcagcggtggacaggtaaactcatacccttctctgaaagaggctctgaagccagtcctagacacgagaaaggggacgagggtagcccggcggaacgcacctaagctttgcgggtgcgtggggcgattaagtgtgcgagaggagttttctggaacattacaagggcgttcgacatactcgtacttgtactcatacctgtgtctccgtggcatccattacggttgcttcatgcgattaggaatttccctcacacacacagcgtctgcagctgcaaacaaccatatatcgcactctaatgggccgtctaaacacgaagagaccagaccggggctgtgctgagcttactgcgtgggtttagctgccggccgcgtggttccggggcgatattccgtcaaaaacctgcgttacgagcgatacgagagcgtcatgcaggagtgactcgcttttctattcttccagggtgcattttgttggggagcgaggttgagtctggtgatgaagtttggagcatgtctgggtcgaccgcgagaaggggcccagggtgtagagttaccgagaccgaggtgatgttgatatgcatccgagacattggtttttggagttgggctttggagcatgggatctagagggcaaggactggtatcaggatcagtatagcatacgaaggatatactcgcttgcacatctgctggttcctagaagacggtataaaagacgacatgatggaacatgtgtggtcacgtcgctctggcggtgccatttcctgctatttccacatttgtctcgctaaaatcacctaaaatacccattatatgtctcacttgcaacccccacaaactctccttcgttttcttatcggaaacagatgcatggtaatctgataaaagagcgggtaccaacgccatttggagggatagaagatggtgcgcaacagtgcgagtactgctatcgtcatctatgacaggttcgcagtcggccggaggcacgcaaggccctctccttttgttcctctgtagaaccctcgtctcgctaactttgcttccttagtgcccaacacaacaactggagactaccgtagccctctggctatagacacaagcatttgcaacgtggggcgctggtgtctgtgtgtggggccctgtttgggtaggaggaagagaaagaaaaacccaccttgcaaaaaaacaacaaaaaaaaaaaaaaaaaaaaagacaacaatgccggtttttcgtcgcccctccaaagttcacccggttgttgagatgcacatgataatgagaggcgcatgataatgagaggcgcatggtatcagtgcgacaacagacagcgagtgagtgggattcaggacagctcaggtgtgttccaacaagctgaggcatcgcggccaaagaaccaaccaaaaatggatctaaacacatgcagccgtggataggctatccttcttctggtataggtttgtctcgtagccccttgtgccagggtaaatccgaaaatccagaagctaatttggacgaggttagctccccactttagagttggtccgagtgcaggcgataggacgggatggaaatatagaaaaaggcgggtcccctaaaagctgacatgatcgtccagtaaacctcccccaaacgaccaccaggagccatgtcgtcgacacgcaccaccaccgccgccggccaaatccgcttccgagcagacccctgcgctcaggaatcgttcatagaacatgcccaacacacggtgacagacaccatagaggaggtcaaggagtcgctgactcacctgtgggacgacattcccgcgtggcaacgagacaactgctacatacgaaggggctacgtcaaggaaaccaactgctacaaaaagaccttcaaagccttgggctttgtccacaatgagacggtcaacatctactcgcacctgatcccggccctcaccacctttgtgggaggcgtggcggcctacggactgggcacctacctcgacgtgggtctgcccatctaccccacaaccacctggaaggaccacggcgtcttcattctcttcatgtttggaatcgtctcgtgtctgggcatgagtgccaccttccactgcatcaagtgccactcgcagcaggtggcccgaaccggcaaccagctcgactatctgggaatcgtgtcgcttgtcgtctcctccatgttcggcatcatcttctacggttacgaccacggagactacgaacgatggctgtactggggcctgaccttttcgctgggcacaatctgtgcttgcgtgtcgctcatgaaaaagttccacaccagcgaatggcggccgttccgagccctcatgtttgtgctctttggtctctccggaggcttccccgtcatccacgcctgtttccgattcggatacgaaggaaccgttctgcggatccagctgccttggatcttgctcgaggcggccgcctatattggcggagccggcatctacgccgcccgagtgcccgaaaagtggtcccccggtacctttgacatcatcggctcgtcccaccagattttccacatgtgcgtggttctgggtgtcattctgcactggattgccctgctgggaacctaccacgcctaccacggatgggccctgtctcagagccctattttcttccgataaccaccatcctggagatgtccacactaacaagctcgtttcgtatcctagctctcaggcagacccaggatcatagatgtagttataaaaagcaacgttacatgccaactttggaggtaccagtagcaaccgggtgcaatttccctgtcatgtcaacccaaccacagtagcagccatccttatagtccaatctgactgttatcataaatgccatgtatggaggatgttgcatgaggcggtctggaaccatgtctggagcaatgtatcggatgtttcaaaggagggggaaatgtgggcctccgtaagatgtcgatgaggtccatggatagattgaaatgagcgatattgtccttacacgacaactagaccgagttatatatcttggttatcggccaagattcggctaatgaaactttatagggagattggctcggggctctttttttttttaattttttttttttttgcactgttctttttcttttggagcccgtcaaaagaaccttggtgctcaacttttgggacgggctggaaaagaaggaagctgccaacgatcttgtccactctgtttcggtcacgtgacctggaatttcccgcgacccatggtcaatttgtaggttccatctctacgcctctaacgccgcctctaacttaatgtgagaatacgactgggtattgtaggtggtgtagggaggggtttgtttgcgggtgtatgggttgagatatggcgattctgaaaagtgcattttgtggagaatcttctgtttaccctgtttgggatttctccgggtaaaattgcccctttggatccccttgaggcgtctttctttccactgtggccgtaccagtgtacgtatgtatgtactgtactgatactgatactgtacttgaaggagggaatgacgtatgacatcatcaagccccatgtgtcccagtcccaagactgtctggtgcagctgcacataattcgtctctcttcaggggatctcttctccagggcttcttcggattgcttttaattagcccatgtctcttcttccccacatggccccatgttgtccttgtctgcggtacaatactcacatcagatggtcacagcgaccgctagacgcctggtgtaggtccgttttccgagcctttttgacaactgcgcggagtcgcacgtccccgcggtccagctttgtctcagctcagactgtcccagagggtccgccgacggtccatttcggtgtctccaagacaccccctctcgatgcatgtcgcacaaatggaatcacgaaaacggctcgcttggtggatgaactgtatttttggaggagagaagcgactcttgtggcgaccggtgcgacttgtgcttgtgcgacttgtgtggcctgtgcgacttgtacgacttgtacgacttgtacgacttgtacgacttgtacgacttgtacgacttgtacgagactgatattcacgtccacagtcgcttcgaccgtcagaaaacccctctcaacccaccactcaacctaccacaccgtcaatcgtatcaccccaataaagttgcggagtctgttttgggatgccgccctgagacggaaaacgtagacacatgtgtctccgttgtacgagtgagccccaaagggagctataatatcgcgattatgacgtcatacaaagaggaataaaacacgcggttcgctccattctctttgtcgctatccgctcagcttcttcagccccctgtatcagcggccacagcacggctaatggtaggtacaggacataggtacgaacgctccagttgtaccagtctacttgtacgtgtcttcactattatgcatccaccccacatgcaatgtcgatcattgagaggataaaaaaagatcggtgaaagaactgcaaggcgcgcgtagacggactggagtcgggtatcgcagagggtctggcgacctgctggacctccttggttcgtccattgccgcatctcttcaagatgagcttctccagtaccaggtggactcctgaggcccttctcaaatcactcgattgctacttgttctccccaactctatgtgcaactctataaacagtttttccggtgcttcctcctgtacgagtatatgtagagccggcaaacctcccttcgtattccccatctcaatcttcacccacgccacaaatgtctgtcaacccccaggatctcggcgacaaactgcacaacctcaagctcaatgaggacggcacccccacgcgaaagatcatcaagaccaccaaggaggtgattgatcccgtcactaaagagaagaaactcgagtcgtccaccgaagaggtcatttcacacaaccggtacgccaactacgcctttgcgttcgacattgacggcgtgctgctcaagggcgcagacgttatcccccaggcccccgaagccatgcgaatgctcaatggcgagaacgaatacaacattcgcgtcccctacattttcgtcaccaacggctccggtctcaccgaggaggtccggtgcaaaaacctgtcgaaaatgctcgaaaccgaggtcaatcccggccagtttatccagggatccactcccatgagatcgctggtcgaaaagtatgatacggtgctcgtggtcggtggcgtaggagaggcgtgccgaaaggtggccgaggaatacggcttcaaaaacgtggtcacccccggagacattctcaagtggaaccccaacgtgtcgccgttccgaaagctcactgaggaggagtacaatgcttctcgaacgctggatttctccaagattgccattggcgccattctggtgtttgccgactcgcgagaatgggcctcagaccaacagatcatcttggagctcctcatgtccaagaacggcgtcatgggcaccgagtccaagcaattcaacgagggccccgacattttttttgcccacgacgactttgtgtggtccaccaattacaatctgtcgcggtacggcatgggagctctgcaggtctgcatttccgctctctaccaggcccacactggcaaggagctcaacgtgactaagtttggaaagcccaacaaagagaccttcaattttgccaacagcattctcaagagctggcgtcaggacgcctacgagacgcacttttgcaatgacaaggattgcgaagatgaggaccacgccaagaacggcaaaaaggaggagtctgccagtgacaagaagctcagagaggccgaaaacaatgaggatacagtagtggccaaggccgaggagactaccaatgctgacggctccaaaaccgaggtctttgacctgcttcctgccgcccagaccgtttactttgttggagacacccccgagtcggatatccgattcgcaaacacctttgacaagacgtggtactcgatcctggtcaagaccggagtgtaccaggacggcaccgaacccgcctacaagcccaagaagattgtggacaacgttctggaagcggtcaagttcgccattcaccgggagcatgagaaggagctggagctcagagagcaggcacgatctgctgtggccagtggatctgctaccccaggaactaagggtgggtccaagactcccgtcgaaagtttgcatcctcatgagctgcagcagttggtcatgacccaggctcatgactaactcggatgaagcgagaattagttgtatgggagcgactgctgctgttcattcgcaaattcccaatattcccaataccaacttctcatctcttttgcatcccccatgctaatcatttgcttactaccatagctattgttggagtctcattataactacttactactatttagctgaatcaaaaactaacaagatggtttgagtgaccaggcagtggtatcgaatccagtacgagtacaagtatgatctacaaccgcaggaggaacacttcaattgaatggtattcgggtctgtacttgtagtatgaaaatagctccagttcgagtgttttggcttgtacactggctgcttgtcaatgttgcctgtcactactcacccaaggacgactcacgcacaattgccaatacacacttttcaatttcagtttcgattggccccggaagaaaggacgctaagcatcccagctggcttatctctgtatgaagtataaacaggcgaagagccgaatacgagccattagccgcgtgtggtgtgactcaatgagctgattgtataacccattgagtctgttcttagagtcggagacagggtgtttgatctggtggatgtggagtatgaagaatgccatcggaatgcgggtgggaggtgcgcgcatgattaacagaagatgttcatgggtgctgcaaatgtggaaaacgagtcctggcatgtgctggtatagggctgagcagtatggacagaaagagccccattctggagactcttaaacaatcaacggcagtagtagaatttctgagtaggcgtagtccgtatcgagacaatccttcagaactgtcgttgtcagtagtttttggttcaagtcacaagactgcgtagtcttcgattaatccgaaggcagtccttgagggcatatgatcctccaccacagacacgtgactgaatggatgcaacatgagtagatagcgatagaaccacatcgaatcacagctatggtatgcgtcttgtgttctcgaggctatgcagtccgtcgacctgtgatctaaccatcaacgccatacccatctctgacatgagaaatcctgtgtcacttgccaggtagcagcgcattcaagtcactactcttcttgatacacatctcttggtcgtgtctagatcacatttggtgtgttttgtcgcgtctcctgctcactcactatcatccccatacaaaacctttgaaacgtcaaccaaaggtagatcccagactccgtctgtggcctcccagaagtactcgccgttcttgcctccgtcaactcgagcatgttcgtccacaatcacctcgagccggtccagcggatatgtcatgacctcaatgttgtagagggtgagaaagacgtaggtgaagatgaaggctgcaatgagccacgagggaatggccagcgcccaccatcgcgacggaaagtagtagatgtgcaggtagtgaagtagccatgtaggggagagagaccacagaaagaacaccaaggcggcgatgttggcacctatatatagggccatccccttgtactctgttcggggcgggaccgcaaacgcgcccacggtcacgtccgagttttttgctagcgtgtccatgctgcgatgttggggtgtgcgaggcagatcaatgtggtgatggatgtagagttggagaacacatggtgggaggggtttgattaaagtgaaaagttttagttggacttagttggacttagttggacttagttagttttggtagttgggagtagctcgtcaacacgtttttcagactcgattccggcaagacttgtttgctctcggtcgatggccgagtctgagcctgttctggggatgaccatgagtatatcgagtcgagcataataaattaatgttactttatagcgagcaatctacaactgtgccaccatacaacccgatgctacgcaattcaagattcagcctctactcggctaaaactcaagttgagagcaatgtgacaccgtctcatggatttggcaccgctcccgtggccaaagcctctggaaacggtcactactcgcttacaaacaaccaaacagtgcgatacaagaacgagtacagcacaactgtatgtacttgtatggcactggtagcgatgtccaactcgtactcgtaccgtaccagctcaaccctggtacagtttagattctgacctacagcatgattggtaatggacagtaggctgaccaagatggaacatctgggacctgctcagcggaagacgggacaaaagacgccaatccccgtttggggggtcacgtgactctccacgaatatcccggagatggaaagggggtggtgggtcgacggggcgtactttggtggaagttcaatcatcacgtggtttttgtctttgttattgttttttgttttttttattgcatgtcatgtttcaccgctttcgaaaccttgaccttggcccttgagtttcctcaccggatcaacctccccacgagccaagagatgcccttcttctaacggcaaccgagagcgcgggcggggtagttggggcgggagagtcgagtctgtttgtgtggtgcgtgttgacgggacgatagcgccctagttgtactgtttatgttgtctgttcttcgtctgcaacttcccttcttgtatttttaaccgactcgtgatagagttgattttgcatgtacgagtacgatagttgttggagtaggcaacctgtgtatcttcatggtgacgccataccgaagcccataccgaagctcgccgtcaccaattggctgattgttgtcctttggttgtcagaaatggcgaaataccgcggattctgtcttgtatctggtctgtcttgtatctggtctgccctgtatctggtctgccctgtatctggtctgtcttgtacatacttagacctggttgctgacctaccgctgacatgcccatgacacatatatgctgccgggccgacggggctggcggccacattctagaagcaggcaaccagactcttgtctcgtgtcaggcgaggtttcggaatgtcggttccgcggtgaggcgatgaaaaagggtcgaccgaatgggcgacagaatcggttgacagaatggggtagctgtatggtgcttcttggcggcagagacaaagccgtcggaacagcgtcggatcggagttttgcggattaataacttggctgtctacaaatactggctggtggtgttacgagcgagtacggtacagtacttgtatataccatgcggtacgggcacggtacaatactgtacggtgcaataagatgagtgggagggtcatttgagtgtacagtatgtacggtgaatgaagtaagaaccatgtgcaagtagccgagaggaatggcgagttgaagtcacgagatggagcacaatcggcggcgaaacgcgcactattattgcattccctacttgcgcgcacaacccattctccccttgcaccctggcacctcctcctccattgctccgtacgcttgtagagttggtttgcttgcatgcgtcattgtgcatccacgtggggatggcgagaaaagaaaatgtgtcggtcagaaaagacacggatttgtggggcagtgtttgcgggaggagacaagagactcgagcactcgcgtcgggcgtcttcgagccgatattatcggttcaacttcggctcatctgcagccatcacgtgcctccaccaggctccgattccgttattatggaaatttcggcgacggcaaaacaaaaatggaaagaaaaaacatggaaagaaaaaaaaaaagggttgtagacctcagccgtataccgcactttatgccagtcacccgaccttgctggccatagtacaatagagggaatagattggccaggtgcaactacaagcgccatatatgagctgagagctgtaaagacgacgtaacacgtccataatgcacaagtcccgttgaccaccaggtgcacggtggttccgcgagagagcgcaaaccaccgcaaagcaaagtggtgtgtaatattttgctagtcgagctagcgcattgcgtgatagtcttgtcaagagctgtgtacggacgtcgtatgtagacatacaatacaatagtctaagtgcaccggcgtccttttgcagacccttgccgcgtgtttttggacccacctgccccgtttgtgcctgcctggcttctccattttcagcctgccgtctctctgcattttctactctctcattttttggttttttggagcgtttgagaccaactcccccttttatacttttgttaaagttaactcaacgagagcccatctcgccattcccaagctctctcatcactgtcgacatccccccaaaacacacgctacaatgaccgtgcaaacctccaccgaagccgtggacgagctgcagcccgtgcccgaggcctgcgggtcctgtgagtcattcgacggatgcgtaaatggccattcccactacccacaagcaacacaggctcagcccacacaagcaacacaggcacaagcgccggtggcatctcccacacaaccaatgtcgtcgccgccaccgacacaaccccagccggtccccggaagtcgaccgccaggacgaacccccagcggcgtgtcgtcctacgacgctcccatgcgctcctccacgtccatgggctcccagaatggaggaggcatgatcctcgacacagaactgccgtcccaccaagacaccaagctcaaggtgggctcgtacgtgccgtcatcaggcgaagagaccaccgacgacgagggtatcaacttcatggcgacccggcggttcccgccccgcacctcgccgcccagagaaaaggaaaacgtgcaccacgacgccgacacgggctcgccacacggatccttagaaaagaaaaaatcgtcgcgaggactgtcccgactcttctcaaagacaaagctctttgaccataaggaccactccaaggatcacgccaaggacgatcattccaaacgagaacgcggcttctcgctcacccgacggttcaccaacaaggaaaagaaggacaaggaaaaggaccattcccacccgggaggcatggacgtacccaaagccagaccgcgaactaacacactcgacacccacgccaacctcccccactcgacaagatcaccctccggatacacccgtggatcctcggtgcccaccaagagcatcacccgcgcaaacacagacacggagctatcgcgcaaggagcagtcgctgtcgtcgctgcgaaacggaggccatgccacctctgcgggaggcatgcccttgtctcctggcacctctcgacggtactcgggccaccagcctctgcgtccccgtgtcatgacccagacccgtcagccatcgttgcctcataatagtgacatttgcgacatccccttcgtgccctctacccccaaatatctgctcagtcctgccaagatcatgaaaccgtccgagtttctgcccccggagtacaacaccgatcctccggacatggacatttgcaccaagtacgcggcggaaaagaagctgtcgaaaacaaagcagctgggccgaggtgccacggccgtggtcgaaaaggtgaatgagatcgagtccaagatggtacgtgccgtcaagatctacaacaagcgctccgcggacacggatgctaaggacttctacgactcggtggcagaggaatacgtgatttcgcgcaagctgcaaggccaccgcaacattgtgcgggtcatggagctgtgtctgggctaccacgactcgtggtgctgtgtcatggagttctgcccccagggcgacatgttctcactgctggagtcgtataaggcccagaagaagaagatgcccaaagacgagcgaaactgcctgttccggcagctgctcatgggcgtggccttcatgcatcgaaacggtgttgcccacagagacatcaaacccgaaaacctactgctcacagacggaacgctcaaaatcaccgactttggtgtctcggtgcaaatgttcgatcccgaggtgcccgacgggcccatcaagtactgtgccggaatctccggttctgagccttacatctctcccgaggtgtttgagtccaaggtgagctacaaggaagacacccctgagcagctcattggtcgatatgacggccggctgctggacgtgtggtcgtgtgccattgtcttcgttaacctggtgcttaatggaggtctgttcgcaaaggcctccatggacgacctcaactacaaaaagttccaggacgaactggaccggtactggcgcagagaggaaaacttccagaagttccaccgtaacgagctcactggaaagggctcgcagctcgacttgtctgactcgtgcggcaacggagctacccagatgggtgctttagaggctgctcttcaggaggaggccaacttggtgtcttccgtggtcccctctccccgtcagtcatcttctaatctgacgggaatgggttccatttcgcggtccgatctgcgtcttggcggcggcgaaatggcccctcttccttatttcaatgagatgggttcgggtctcaagagactcattgcccggatgctcatgcacgaccctcgagaccggccctacatgcccgagatcatttcaagcacgtctgtgcgaaacattggcatgtgtttcccggtggacaacatggaggattacgcgccggatcagtacgtcaagggctcgctcgcagagctgtatggatacgatttggccatcaagcgggtcacgagcgccgaccagacgctcaagaaggaggaaaagtttgtccgcaaccataatcatgagcctctcagcgctcctcccagtacctttggtattggcactttccgggacccttactaggacccgattctagcatacggcaactcctccctagcactataggttttgtatttatttatagacattcaggattacacaatggtatcgtagaggggtggtgacaatggcatctttgcagtagcctggtacatgcaatagctcatgatacaagtacaagtacaggtataatacatgtctaagatttatcataagatcgacaggggattaatggaatccgagctgttggtacctaatgaaaatacgagtaggatagacgggttattgtatgacgttgaatatacatggcaatggagagtgaccttgcgagtgctctgatacgactctgtagtgtagtatcaaagtattttctgatcaagaggctctgggtcttcttgaatcaccccttgtattgtcatgtctttttctagcggcatctacgagtacagtttggccagtactattcaccaccatgcgttgaagagtcctaagagtcttgccgtacctacttcaaatgttcatgtcgaaataccgccaaaagacgctctcagtgctttctaaagatccccaagtccttgcgcttcaggatgctgtcgaaagggttcgagcgccgtatatccattcaatcataaatactactgttcttctccatcatgagcatgtgcagccagcacctgagcctcagcctccttttcaatagcctccttcacgtgtgcaggaatgggagcagcagcaatagtggctccattctctccgggctcctgcttgatgagatccgggttaatttggggagacgaagggttggaggacatctggcgctctcgggcaatgcgggcctcaatctcccgcagctcttgttcccgagccaacagctccagcttcttttcattgatttccttctgcacccgcaactcaatctcccgtagcttctcttcctcccgtgccagctgctcctccttgagcatgtagctctggttggcgagctcctcagggttgagcgagtcgtcgtgtgcgcccgaggggttggggcccgagtagccttttgacagccgttcggttcggtagttttcgtatagaaagtcgtgtgtcagcagcttgaggtcctgcaggtgtgagcccagcagtgcggacttgagagcgacaaagtcgctgtgttcggggttctcaatctccacgttaccccaagggtatgctcgcacggggatgtcttctccgttagggcccttggcgtaggcgttgccagacacaatggcgaatggcagcagcttgcgcaggtaggtgttttcctctatggtttcctcgtcgtcgtcttcgggatcaaaggggaagttgtagatgggaatctggtggtggtccacgtcgtccatgatgaggcgtttgttgagggcgacctctgcgggggtgagggcgtctgatcggccaatcacggggatgatgttgactcgcttggacagtcgcttcatgagctccacgtcgagctctcggagtccgtggcctgtggcttcgataaagtagagcagcacgtggactctgttatccttgaaccgggggtttcgtcggattcgcgactcttcggacagaatgtcgtcgtactggtgctccaggtacttgagaatggcgtcaaaacactcgtcattgttgatgttgtctccaaatccgggggtgtcaacaatggtgagggtcactcgggtgccgtcttcctcgtccagatcgacggttcggggctggacctcgattccgggatcaagatgggcgtgctcgggagtatactcttgtggggaaagcacttccactccgcacagcgagttaatgaaggtggttcttccggtgcccgaagcacccaccaccatgatggagaaggaaatgcccttcttgacgtttttctttcgtcgcagctgtgttagaggcgtctgttcaccgtccaattccgtctttccacactcacaatagccgaagaactcatgattctgtgcaggtttttcgatatgtcgtgtctggtagaaaaggggctactcaaggtaccggtgtacgagtctacataacagcgctgttggcgcagaccattagggttagggcccgagtctcgccaggcgcagagatgtcaacttttcgcgtgttttttggtctcaaacgccgccgtggacgccaagcgacgcgtttcgtttctattggctaatgtcgtttgtcggttggccgtttgtttgtgtcaaaatcagccacctttcgtctcctcagctactcttctcgctataaaccctcgtgacacgtagactccaaaaagttgtcaatgttgattttggttttggtgggaggtgcactggtgctgtcagaatatacaacgagtatcgtacgtacttgtacgagaacatgttgacaagcggctgatttggactgcaccggaaccgataggtcggtagagtgctaactgtcataaaacggccctattgctcgtgctgaaacctcttgtattatgtaatcgctccgaattgctctttctctgaagcgctctgtctccgaatccgaatcgtgtctcccaatcgcccttgtctctgattctcccctgttgtttcaggatattctgaaacagctactgcggagttggtaaggaacacgagcgagcgtctgactgggtgtcggactgtgtctgacggactgggtgtctgtctgtctgtctgattctcaccctgtctgtctgattctctctctgtctgttatctgactgtctgtctatctgactgtctgtctatctgactatcgtttgatatatattatttaaaataggggccagggtaaggacaggaacctcgtccaacgatagggtcgtagataacgagtctcaactgttctatgaatgccaggggaaaaatatgggcctgtcttgagttctttggataatttgggtcagtatcgcgtatacaacacttgtatatttgtgatggcctgttaagtagatggactagatgaactaagaaaaagtggaggagattacagcgagttactgaagtggggaacgaatgcgagcgcaacatgtagcacagagaccttctgcgagggaggaggatgctctgtcactgttgcttggatatggatacaactactgactatccaactattgtacttcctcctccgtggagtttatatcaacttttcaacaaccaccttgaagctgaaatgcacacagcttgtcggtttctatatgcagttttcaaccatttcggtgctgtgagtacttccaggagtcctttgaagaacgtgaatcgttgtatacctctcagtcagacgtctccgaccgatatctcctccatggtggtccataatgacaccacctgaaccgtgagacgagtcagggtccgtgtcttctattttctaccatggttgtagccatttctctctcttcctcaggtctctgataccggctggtgatattaccacttcatgtatcgactgttgcatcttaataagccccgttctttctgtttatgtcaccttgaaggcccaacagatcgcgtcaatgtcttatcagatgaacacaataactgcaacggatatcaatcctcctgttggtccgtcaagctgctcatggatctaataacttttcggtccatgttcaatcagtgtcggttgtgtcgacttgatcagattctggttgttttctggttgtgattccgctcttcatatcgccgtcggaaacattgtgagtggttacacaggtgaattccccaattggcaacggctggtcgcaggtgcacactagtgtcagtacttgtagtcattccatatatggtccaacgtttacttcttcgttggtatcgaaatcttcagaccaccctacagtgttcatatctcctcctgttgcacgtaaatcatatctcattataaatacttgtcgcctcgcttacttggaggtgtccagaacgtatcggccggcaatcttgccctcctccataagcttgtagaccttttccagctcggacagaccgatgatgatgatgggcgacttgacgagacctcgggagaagaactcaatggcctcctgggagtcggctcggtttccaacgtaagagcccttgatctggatagatcgagccacctgctggaagatgggagacttgcagacggcgccggcgggcagaccgaccaaaacaacggttcccagggttcgcacgtactcaatggactggttgactgcaaactcggagacagacacattgatgacggcgtggggtccgcccttggtggcctcctggacgtccttgacgaggtccttggtcttggcaaagtcgatgaaaacctcggcaccaaggtccttgcacatcttctccttgtcggcgccagtgtcaatggccagcactcggtagcccatggccttggcgtactggacagcaagtgttccgagtcctcctccagcaccagtaacggcaacccactggccagcgaggatggcggcagtcttgagagccttgtagacggtgattccggcgcacagaatgggggcaatctcggcgagatcgcagttcttgggaatgtgcgcggcctgcacggcgttggcggtggcgtactgctggaaagagccgtcgtgggtgtatccagacatggtagcgttgggacagttgggctcggcggccacctggcagaactcgcaggtgtagcaggccttgttgatccacttgatgccggcatagtcgccaatctcaaacgtgtcaacgttcttacccttggcaacaaccactccggcaccctcgtggcctccgaccagaggaagcttggtgtccagaggccagtcgcccttccaggcgtgcagatccgtgtggcagactccggagaacttgacgttgaccagaatctcgtcgtcggcaggcacaggcacggggatgtccttgtacatgagaggaccgccggaggtctcgaagatgacacccttctgggtcttggggatgacgggagcagacattgtgatgagtggtggtggtggtggtagtagtagttggttgtagggacctggagctggggatttggctgctctttatacagctccgagctccatttggccacatttgcggctctcgacaaacttctttcgggaagtagccctaactcactccccacatgtacttgctgcacgagaaagggaggtgtgggggagctgaacgaggggcgggaggaggcgggagagtgttgatctggggtgttttggcggctctgagtcgattggtgcttgcagattccacttatctgctctccttccgcctccagtcccatctctttgaaaaaacacctgactccctcgtctccaccatacttgtcagatgcacctacagaaaccgtatatcgccaagtgtgcagtacggttgagtctaaagcatgagtttgccggtcgggcggattcgaaaaagtcagagacaagagacgaaaccacaacaaaagaccaatccatgcacattgaccccgcaattgctccgcacatccggcctcgtatctgatgaggggtacttcttatgcggcttgcggagtcggtttttttacagatcgcctatcgcctggtcgttttctcccagcccagccctactcctgccccgttgtgcctcttagtatttcgcttgaaaaaaaaatgagcccacttcagcccttgttctctccatctcggtcgacttgttagcgccaaccttgccttagcgtgggaaatacgacggccagagtatgatgcgtgaactgaagtgttggggatgcacggctggaccttccattggactttctgtggggcttccttgggggggctcctcgaacctgtggcgagtacgagctcttgtagtgccaaacaagtgccattgcacctctccaaacacctacacaactcccccaatgtaatcttgtcatccacggacaagtataagaacccctctaaaccctgtaaactcactcatccttattcctaccagtaccagaacggctaagagtaccacctactgtactcactctcacttacgcaacataattacaacaggctcagaacattgtgctcaacaagttgcatgtccggagtctcggtcggccgacttaggtttgagattttccggtacctgtacttggtgatatagcggtggcctttggtacgaggagtactcactcgcccaggaagacgtgttgatcccagcaccaataccgtacaatggtgctcgctacactgctgtttgctcgcggtgccaaatttcaaagaagacctttcgttagtgcgccggtaccgtaccgttagagtatcgctatctctctgggctgatctgtcatcagactcggcacggaatggtattacgctcagcgacctactgtgtaatccctcaacctagactctccgtagctatcgcgggatttgaatggggtgatttggatgagtgcacgacggggtttatacgggacagggctgtcggttggcacgcacggtcttggtctcactggatcaatttactccatactccgagatgcagcatccatgtccggtggctagtgccgtacgtggaatgttcgagcaatgtgcaactgggtgtaggctgtgtctcggatgtgaattggttgtggtcgacacgtcttgactacaccaagtgaagcttcatcaactccccagctatggcaacagtctaatcagcaacttctctactttagttgattgactagttgactttttgttgaacaaagtttcggaattttcaagttgttctggaatccagtcggaagtcataacttcaaatcagaatctcaagtcggagaatcatagggcaaaaacacacccccatcccaatccatctaaacctcgccccatttgctcctcctcgcccttctgaactagcctatctcccatctcattacgtcagcaacaccctgactctcccaccgcatcacatgaccgtgcatgcacatctcctagtgagccatcggtcatctacaacacacaccatggcgaagaaaaagaagttggacgacggaaaagcccaggaaatgcccgagtcgggagatgaaaacgaagaggaagatgaggacgacggccagggacttacgtcgttactgggcaacaacgccagtggagaaatgaccaaccaggaaatggaggccgaaaagctgcggattctcatgaagaacttcgacaccgagcagatgaaccgatacgaggtctttcgacgagctaacatcaaccggcccggtgtgaaaaagctcgccaacgctgttctcaaccagagtatcaccgccaacgtcgcggtggtactgtcaggtatctccaaggtgtttattggagagatcatcgagaaggccaaggacgtgcaactgcggatgaacccgcgatatgagggagacgacacttacgaaaacgcgtcgcctctgttgccagaacatgtgcgggaggcctggagaatgtacaagttggaaagtggacaggttcccaatgctcattggagacgacagggaggaggaggagatggacgcatgtttagatagtatttattagtaatgaaacaatgacttagaaagtgggtcacagcacccaatatgtctacttttagctactgtactgtatgtctcgtgagaaaataatgtacttactacttgtagcggtacctatagcgatactaatcacatgagacacaatatagatcctcaacgaacatgtctgcgctcaaatgttggcagaaatatgcccgcccttgttagttctccccttcttatcctccagatcataccgcttgctctccttggacgtgttgatctgcacacaaagagaccgcttgtcagtatcaaacagctcattgtagaactgcttcatctcttcaagagacaccgttttggccagctcgattgcttcggcgtcaacattgaagccccagctgttgcacagcttgctccaaacatgccgagactgtaccatcaacgacttgggaggtttggacacctgggcaatgaatccagcagtgtacttttcaaactcctcgaccgtcatcttttccataatggcagccatgtgcacagtgaggaactcgtccattagagccttgacatcgtcagcatggtaggccgactgggtgagtagagaaagaccaccagtggaaaagttgcgttcaaatcccgctcgagcaacgtaaccaagctgtttcttggttcgcagaaacgtaaacgcaggctccttgattatataagccaacaggcgggccttttcaacctgcgtcgactcaaagtaatacagaacacagttgtcagcattgtccacattgagagagggtctagcagcaatcttggagccataaaggggtgtagagatcagtttttgaggcagattaagcacatctccacacttgaactcttcaataactctgccatgaatctcatgggccttggactcgctgaaattgcctgagaccaaaactcgaggagagcattcggaaatgatcttggccatatgagccctgacttcctcaagagtgatttccttttcttctatggaagctagacgctcttccaaagtgaactgttgctcatcgacttcggcagaaagatactcgtcaatgatctggaacgagctgttgaacttggcgttggaaagagctcgcttgagtcgctcaagacgcagactaaaccgtccagggtcgatatcagacttgagagtctcgtacgactgatccaacaacacagacagcttgtcattgaacccagcaacctgcacaatcactccataggtgcctctgtggatggaaagaccgagaccggcagaggcagcatcgtacgagtacttttcagcagcatcactccacagactgcatgcgagacgggttagcaatgagtttctgactgtgtcgctagtatttggatggttcaatccgacaataatcatacctttgggggtttcaaacatgtgatctgggaagtaagacaatgtgggagagagagtcttgggcttgtagtgctctgtcaaagggatatcttctttcttctcattcaaaatagtaaactcctctgcaatgtaaggatttttctgagggagatggaatctcttgggaaaagaagatttgagcgcctcactaaacttgtccacagtctctttctttaactgagaaacactatacttggttccgcagtgctgttcagtcaaatcacacttgtccttcacttcaggagccacaagagtcactctgaggttatcaggagtcaatctggtcagaaactcctccagaacttctgcattgtaggtcttcatcaggtggttgtagctcactacctccgatgcagcacactgcttgttggcaaaagttgctgacaatgcggatgcctcgctcatgatctgagtgggagtctctttgaaatcgaaaaacagctgacagatgtccttggactcatcaaagaaccacttttgggggccctcagcccgcagcatagccaaatactcgaatagagctgctccgatttcttcagtatgctgtgcaccctcagtggtgagattcactgtcacagaaaagagccctccctcggaagagagatagttgatatgagcagacacagagtcggcccagcccttttgtttgaggtaccagtacagacttccgggtgattcgtggcccaccagctgtgcgtagtacgaattgacggagtactctcccagttgtctccatccaggcacctcaaattcgtacttgacaaaccgtttctctgagagcggcacaatctgcagaaacgagtttcgggggtccagcatgggctgtttgagtactggaatgggcaggttcttgttaggaatgtcctcgaaaacctgcaccagattctccagctcgcccatgtcgcggcccatgagcaccaggcgcatcttggacgcacaatactggttcttgtggaactctagaagccgatctcgcactccaggcttgtccagagtgtgtttgctgcctgtactgaacttgtggtgggggtgctctttactacccgtcagtctagatacatgcaagatacgcctggagtccaactgtgtgtttttctcgtgctccgagttgacggcgttgatttcacggtctttgcagtccggatcgaatagcggctcgatgaaaaactgcgcaaagcggtccacggcttcttggaacgcgctgtttttgatctggaagtggtagttggtgatctgggtggacgtgaaggcgttactagcgccgctgttggtcaaaatgaactgcttgtactcgttctcgcgagggtactttttggtgcccagaaacatgaggtgctcgcagaaatgcgccagcccaggcaagtcttcgggatcatcgtagtagccggcatgaacggctagagaggccgaagacatggtggtcgtcttgtctgccaccagcagagcctcgaggcggttgccgagccgcacagacttgtaatcgcgcgaatccagacgcggtttcacaattggtgtttccatggcgagtttcaggccgtttctcagatgtgggagcatgacaaaataagaggtcagatgtctgacgacttatcagcgcagggtcaggaagcttatttgaagtgtgggttttttttttgttgttgtttttttgttttttgttttttttgagaggatttcgggagaaacttggagaggagcaatgtggaaaattcaagcccccttcatgatatctacgcgttgttctttcgtcaaagtgtctatgagcttcactccggcctcatctgatgttctttgaaggcatgtagaccatacacttcttcagcgctagccattgtagtggagctaccttaccacattcaattaccaccacccctggggcctggatgaataattcattcacttataattggctgtgcgtgacacctcttgccacgtacaacatgctgataaataccttgaccaaatacccctcccctatggccctatagcttcacctcctgcctggtaggatcgctgcttcgacgctgtagctctggaggagtagagctccattcggatgaactgccctccatgggaacaggaggagtccccagaggaggcaccgagtggcccacaaaatgccgacgtcgctcagtcatcaataaatgcatctggtgacgcagacctgaaaccacattcacaattgcatggatgtcgtctcgagtccgcatgttttcccgcatcgtctgcatcgacgtgttcacctcgtagtccgccagcaactggttgatggccaggatgtcgcctctcatcttgtcacactcagttcgcacaccttgtagatcgtctcgcgtgacactgggaagcagctcaaagcccgcatctgcagactgctggagatccagacgatctaggcgataccgtagcgcctggttctcgtgtcggaggccttcaattttttcctcctgggcttccaaaacaggtgccagctgagaatacgtgcaggaagctgtatgaatgtggctcagacgtcttgcaccttcccatcgacacccaaacttctcggccggacaactaatgggtcgttccgaacactcggacatgtgatcgtcatgtagctgtgcggtgattgtctcctgacagaatagacagctcaaatgtgactctgtacactcctgtttgcagtgatcaatgtaagcaatgaagggcatttccacgtcgcatccttgcaagcacgtgaccttggtatgcacacacgtaacgcccggcagacgctgttgcaactccttgatatgttcttccgccacatagcgtcgatgcaccagttcgccacatactgtcccctcttccgtcttgccgcgacatgggacctgtgcatagtcgcactgttgacggcagtgcatttccatctggcttcggggccccacatgtgcacagcctcggtttgtgaacgggcacttgacctgcagctcgttcaccagatcaaccagcaccaggggcgctggctgtagcgtttctgggtcgatttggctgcggcaaatgggacagcggttgcccgagtccgccacacgcattgtagacagaatgcacagccggcagaaggtgtggccacactttgtggagtatggagtcacgaatccacaggtgcacactgggcatgacagttgctccggcaggtccatgtattcgagcgaccagtagtccagggtgatgttttcgtcccctggcggcagcgttcttgctagaggttccatttggtgtagatgtgtattcgtagatgttgtaccagtaagtagtgcagtttggcgggtgccagtggtatttttagtatggggtaatactggagcataatgttaacggtgcgccacatacacagcggctgactaaggttggcagttcggttccagtgggtaaacacgactgttaacattattacagccggtctacatactgcgataagacgacagcagcgagcgaccgataacgacaaagacgaccacagaaggcgatcaaaggaagcgatacacacacaaacagctctctcggtctttatcagaacactagtcccatctcttttttgcttgctcacaggtatcgtacatacatacttacttcaatgacaaacctggtactcttggtggaccagacccaagtggctattgacgaacgagagcggctgacgctgctgggaatcaaggcggcggagtcggacgaccgcgacattgagcgggcgctggaaaacatcaaacagggccttttggacaaccgacaagcagcaacccacggaaaggatgttggaaccctgacccgagtgcgagaggactaccacaacctggtgcaggcgtacgagaagatcagtgacacggatctgccggacttgtatctcaacgagtcgctgttcgtcagcaaaaagaagtcggtcaagttccgagacaacaacctggaggaaaccagtggtgcccatagtctcaacgaccagcaccgagactttgaaccataccgagacgaccccgaggccctgattcccgagagatacacagacgaagagcccagcccagcagcccgattcgaggggctgtcgacacagcaggttgtgtactcgcaaagagaagacatgggcgagcaggacgagcgactgagtactctagctcagtcggtttctcgccagcatcagctcagtctgcagattggagccgaagtcgactcccataacgtcatgctggacgatattgaggcccaggtggacaacagtgacggacgtctgaatctggctcgacgacgactggacgacttttcgcgacgagccaaggagtccggctcgctgctgaccatcataattctggtcttcattctcattatcttgattgtattgttgagctagatcaagacgcttgacaaaagacatgaccaaaataatgaccacctttatgactgtaagattaatgagatatgactttgtatagagtagggcggtgaaggagtgtacaagaagtggtgaaagaggtgtaaagtgaatcacactgtagctagtctcccttggtcgcgcgatagtaaccgacctacaaccactgtactgccacacggtatatacttgtacagtatgtactcgtacattcattgttttgtagtcgttgagtccaacctgactgaagtgtcttggtagacaggaatgacttgctggtaagaggaagagtaggaaagagggacatctgctgtatataacttgtctcaatgcgggttcaagtactgcttgtactcaaacacttgtccaggcatgacacattgttgtagacctattctacttcccggatgtatagcgtacggttatatcatcttattagatgatactgttttataaacaagccgcgtcttggtctcgcacctgttcatgtcactacttttagtcactctgagctgctgtacaagtagttggctccagtctaatgtggatcacttttcagtctagaggactcgcatacggaacactggtcgtacttgtatgtcgttgacagaccaaagagtctacaagaacccttcctggctacacctcttcatgaccatgcggctgttgcgctcacagagccttcataaacgataatgtacattaatcgcatcatagcacggttttcgcccatctctaagagtctgaggaaatcaacgtgctccgcttaaataagttatgatgcaataaatatctagagcttccgaggggagccggtatccatgttggtaggggtggaagctcgtccggtggcgggatcgatgatctcaagcgcctttttggcccgggtcacgccggcagagccgctgggagagggcgaaagaggggacgagtacgagtagttggatccgccg
